United States Patent
Cui et al.

(10) Patent No.: US 11,827,672 B2
(45) Date of Patent: Nov. 28, 2023

(54) CONSTRUCTS TRAGETING CD22 AND USES THEREOF

(71) Applicant: Eureka Therapeutics, Inc., Emeryville, CA (US)

(72) Inventors: Jun Cui, Emeryville, CA (US); Pengbo Zhang, Emeryville, CA (US); Yiyang Xu, Emeryville, CA (US); Shan Li, Emeryville, CA (US); Yixiang Xu, Emeryville, CA (US); Guangyan Xiong, Emeryville, CA (US); Hongruo Yun, Emeryville, CA (US); Lianxing Liu, Emeryville, CA (US); Xiaomei Ge, Emeryville, CA (US); Shaohua Xu, Emeryville, CA (US); Hong Liu, Emeryville, CA (US); Javier Morales, Emeryville, CA (US)

(73) Assignee: Eureka Therapeutics, Inc., Emeryville, CA (US)

( * ) Notice: Subject to any disclaimer, the term of this patent is extended or adjusted under 35 U.S.C. 154(b) by 627 days.

(21) Appl. No.: 17/043,352

(22) PCT Filed: Mar. 29, 2019

(86) PCT No.: PCT/US2019/025032
§ 371 (c)(1),
(2) Date: Sep. 29, 2020

(87) PCT Pub. No.: WO2019/191704
PCT Pub. Date: Oct. 3, 2019

(65) Prior Publication Data
US 2021/0017280 A1    Jan. 21, 2021

Related U.S. Application Data

(60) Provisional application No. 62/650,955, filed on Mar. 30, 2018.

(51) Int. Cl.
| | | |
|---|---|---|
| C07K 16/28 | (2006.01) | |
| A61P 35/00 | (2006.01) | |
| C07K 14/725 | (2006.01) | |
| A61K 39/00 | (2006.01) | |
| G01N 33/574 | (2006.01) | |

(52) U.S. Cl.
CPC .......... *C07K 16/2803* (2013.01); *A61P 35/00* (2018.01); *C07K 14/7051* (2013.01); *C07K 16/2809* (2013.01); *G01N 33/57492* (2013.01); *A61K 2039/505* (2013.01); *C07K 2317/31* (2013.01); *C07K 2317/622* (2013.01); *C07K 2319/02* (2013.01); *C07K 2319/03* (2013.01); *G01N 2333/70503* (2013.01)

(58) Field of Classification Search
CPC ............ C07K 16/2803; C07K 14/7051; C07K 16/2809; C07K 2317/31; C07K 2317/622; C07K 2319/03; A61P 35/00
See application file for complete search history.

(56) References Cited

U.S. PATENT DOCUMENTS

| | | | |
|---|---|---|---|
| 7,091,323 B2 * | 8/2006 | Pan .......................... | A61P 13/12 530/387.3 |
| 10,066,011 B2 * | 9/2018 | Green ...................... | A61P 13/12 |
| 2007/0258981 A1 | 11/2007 | Hillbert et al. | |
| 2010/0143368 A1 | 6/2010 | King et al. | |
| 2016/0362479 A1 | 12/2016 | Schramm et al. | |
| 2017/0058031 A1 | 3/2017 | King et al. | |
| 2017/0145114 A1 | 5/2017 | Popplewell et al. | |

FOREIGN PATENT DOCUMENTS

| | | | | |
|---|---|---|---|---|
| WO | WO-2013059886 A1 * | 5/2013 | ......... | A61K 39/0011 |
| WO | 2016/090312 A1 | 6/2016 | | |
| WO | WO-2016090329 A2 * | 6/2016 | ......... | A61K 47/6803 |
| WO | 2018/056821 A1 | 3/2018 | | |
| WO | 2018/200582 A1 | 11/2018 | | |
| WO | 2018/200585 A1 | 11/2018 | | |

OTHER PUBLICATIONS

Extended European Search Report in EP 19777866.5, dated Dec. 1, 2021, 13 pages.
Wells, et al. "Pre-clinical activity of allogeneic anti-CD22 CAR-T cells for the treatment of B-cell acute lymphoblastic leukemia." Blood (2017): 130 (Suppl_1): 808-808.
International Search Report in PCT/US2019/025032, dated Jul. 19, 2019, 3 pages.
Office Action in CN201980032506.1 dated Aug. 10, 2023, 7 pages.

* cited by examiner

*Primary Examiner* — Daniel E Kolker
*Assistant Examiner* — Brittney E Donoghue
(74) *Attorney, Agent, or Firm* — Kilpatrick Townsend & Stockton LLP

(57) ABSTRACT

Described herein are antibodies (e.g., single chain variable fragment (scFv) antibodies) and constructs comprising antibody moieties that bind to the extracellular domain of CD22 or a portion thereof (e.g., SEQ ID NO: 205 or a portion thereof). Also provided herein are methods of using the same or compositions thereof for the therapeutic treatment of diseases characterized by CD22 expression, in particular, B-cell lymphomas and leukemias.

20 Claims, 16 Drawing Sheets

Specification includes a Sequence Listing.

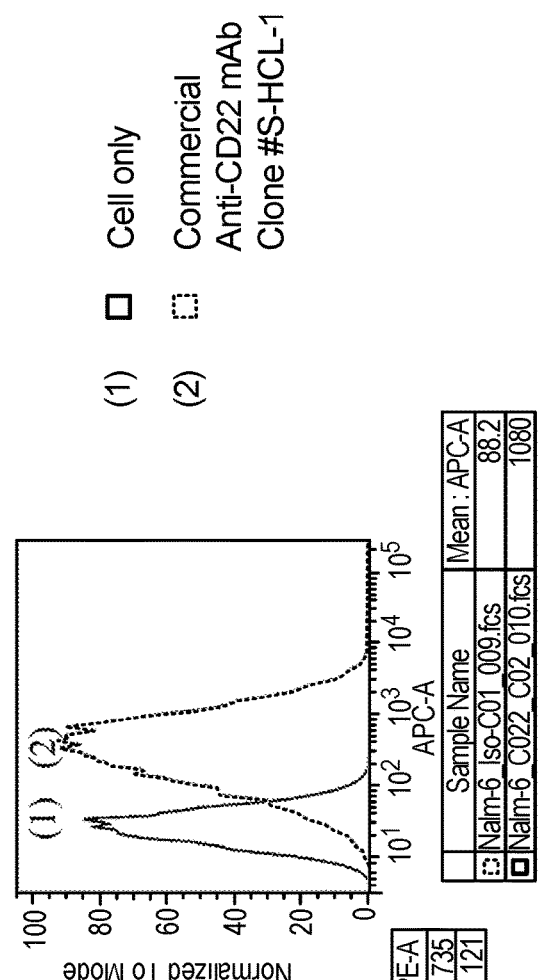

Anti-CD22 clone 1

(1) ▢ Jurkat
(2) ⬚ Jurkat-CD22-full

Anti-CD22 clone 2

(3) ⬚ Jurkat-CD22(D5-D7)-GFP
(4) ⬚ Raji

Anti-CD22 clone 1

(1) ▢ Cell only

Anti-CD22 clone 2

(2) ⬚ With Anti-CD22 phage

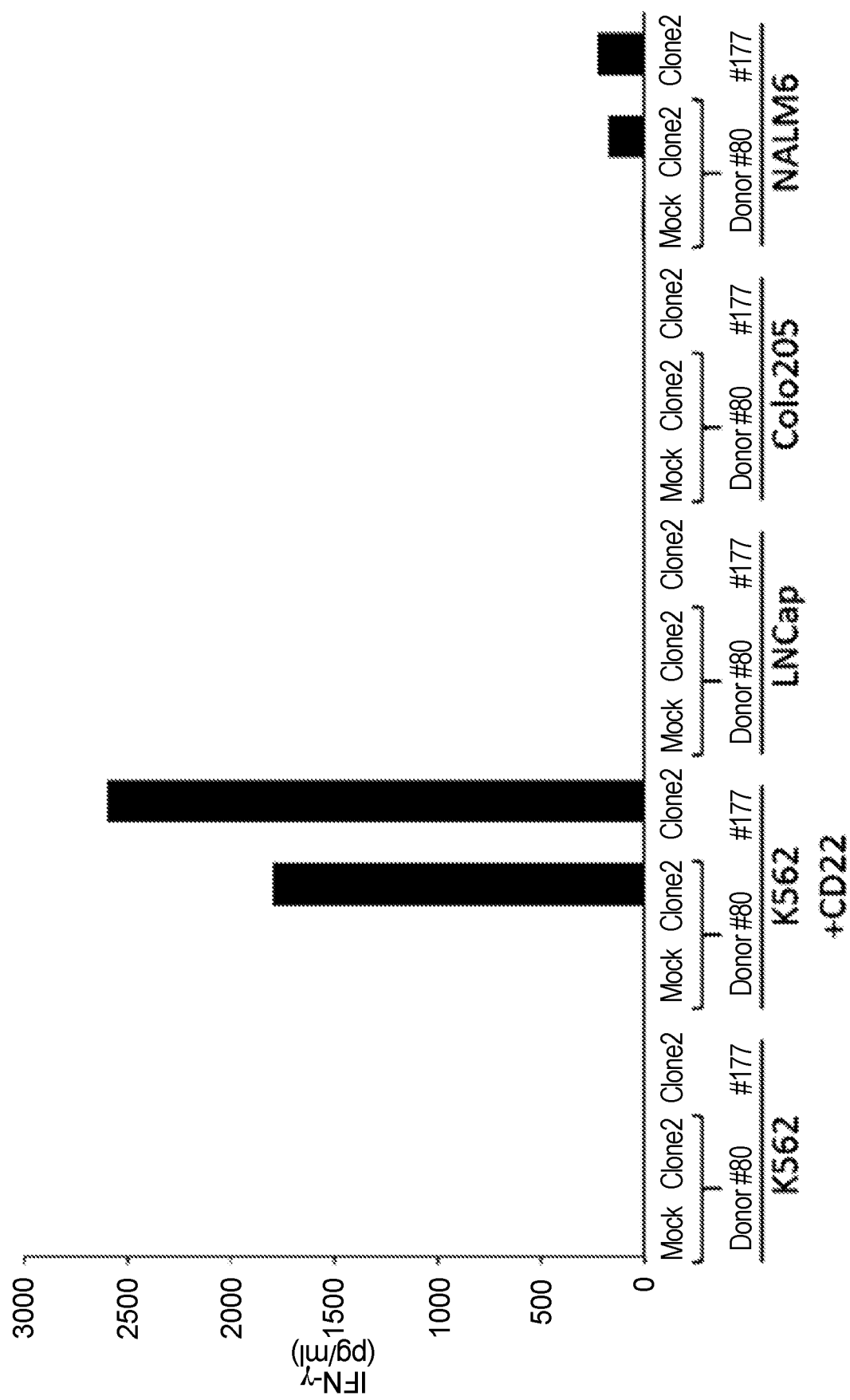

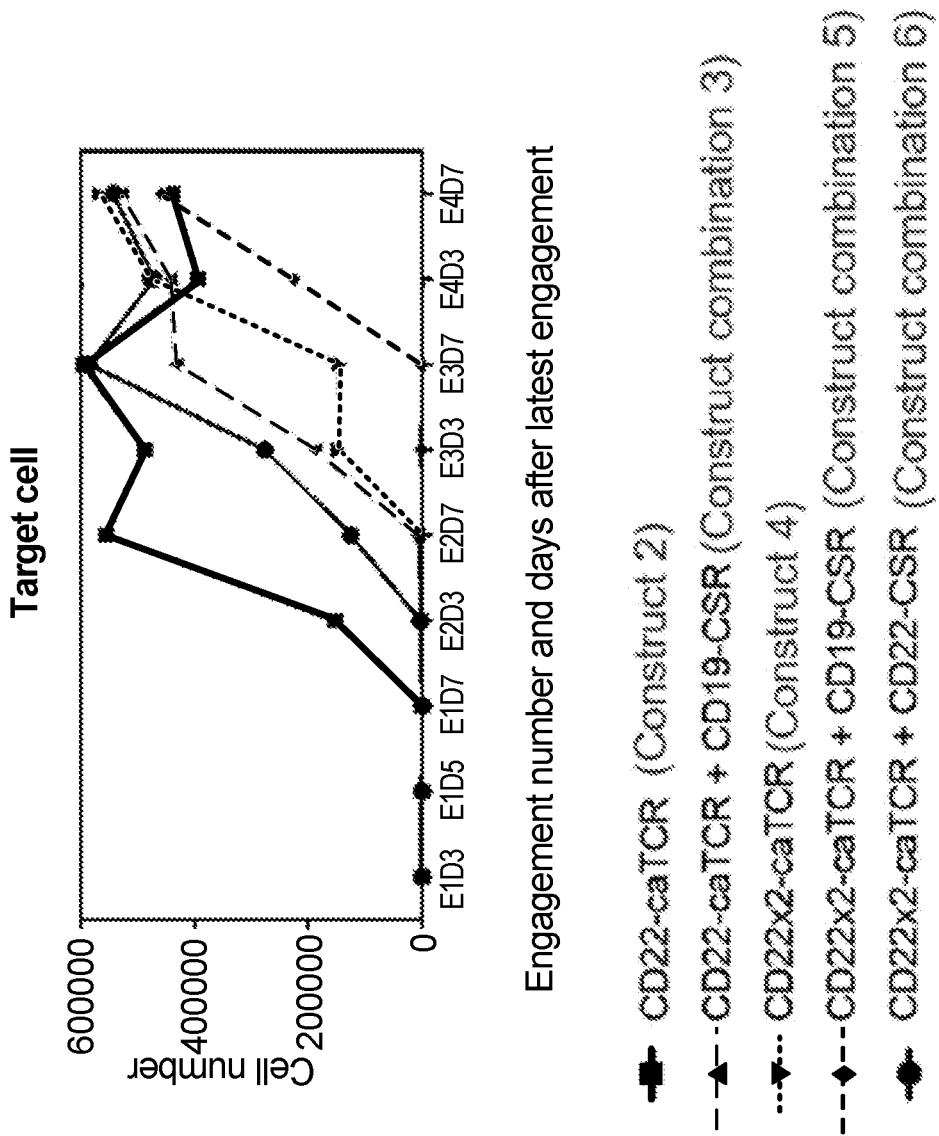

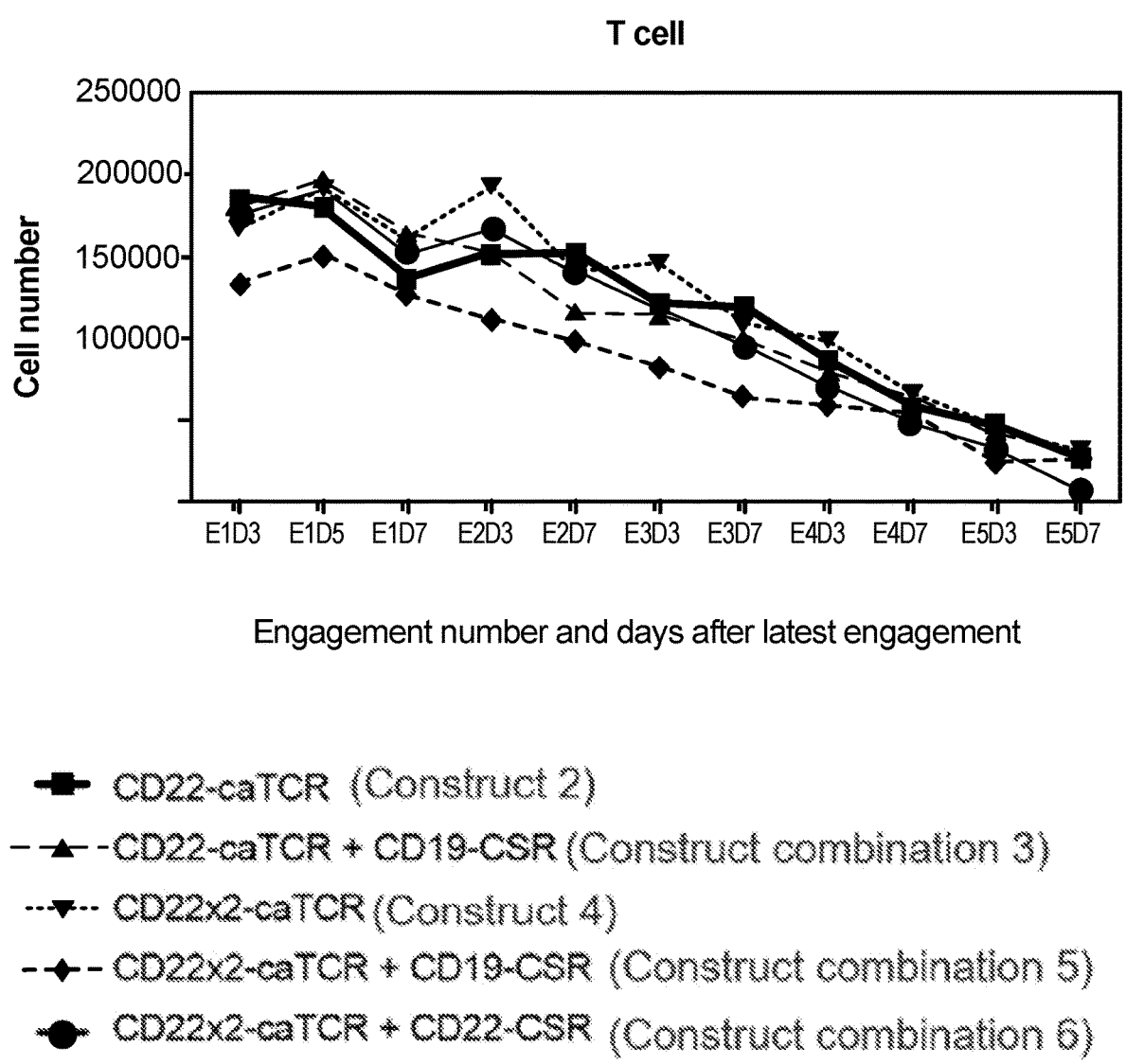

- CD22-CD19-CD20-caTCR-1 (Construct 15)
- CD22-CD19-CD20-caTCR-2 (Construct 16)
- CD22-CD19-CD20-caTCR-3 (Construct 17)
- CD22-CD19-CD20-caTCR-4 (Construct 18)
- CD19-caTCR (Construct 22)
- CD22-caTCR (Construct 2)
- CD20-caTCR (Construct 28)
- Mock

// CONSTRUCTS TARGETING CD22 AND USES THEREOF

CROSS REFERENCE TO RELATED APPLICATIONS

This application is a 371 U.S. National Stage Application of PCT/US2019/025032, International Filing Date Mar. 29, 2019, which claims the benefit of U.S. Provisional Application No. 62/650,955, filed Mar. 30, 2018, the disclosures of which are incorporated herein by reference for all purposes.

REFERENCE TO SUBMISSION OF A SEQUENCE LISTING AS A TEXT FILE

The Sequence Listing written in file 101496-1212310-000310US_SL.txt created on Sep. 29, 2020, 1.265 bytes, machine format IBM-PC, MS-Windows operating system, is hereby incorporated by reference in its entirety for all purposes.

BACKGROUND

Immunotherapies targeting the CD19 B-cell antigen have been particularly efficacious against B-cell malignancies (Lartigue, *Targeted Oncology* Aug. 1, 2014). However, loss of CD19 expression by a tumor cell can render the immunotherapy ineffective and lead to cancer relapse (Grupp et al., *New Engl J Med.* 368: 1509, 2013). The CD19 tumor antigen escape emphasizes the need to target additional B-cells antigens, such as CD22 and CD52 (Grillo-Lopez et al., *Curr Pharm Biotechnol*, 2: 301, 2001).

SUMMARY

The present invention provides, among other things, constructs that specifically bind CD22, in particular human CD22. In some embodiments, an anti-CD22 construct described herein may be a polypeptide or composition comprising the described anti-CD22 antibody moiety. For example, the anti-CD22 constructs can be antibodies, chimeric antigen receptors (CARs), chimeric antibody-T cell receptors (caTCRs), or chimeric signaling receptors (CSRs), demonstrating high specificity for human CD22 in native form (e.g., expressed on the surface of a cell). In some embodiments, provided constructs may effectively mediate killing of cancer cells characterized by CD22 expression (e.g., lymphomas and/or leukemias).

Although embodiments employing constructs that contain human antibodies having, i.e., human heavy and light chain variable region sequences including human CDR sequences, are extensively discussed herein, the present invention also provides constructs that contain non-human antibodies. In some embodiments, non-human antibodies comprise human CDR sequences from an antibody as described herein and non-human framework sequences. Non-human framework sequences include, in some embodiments, any sequence that can be used for generating synthetic heavy and/or light chain variable regions using one or more human CDR sequences as described herein, including, e.g., sequences generated from mouse, rat, rabbit, pig, cow, deer, sheep, goat, cat, dog, monkey, chicken, etc. In some embodiments, a provided construct includes an antibody generated by grafting one or more human CDR sequences as described herein onto a non-human framework sequence (e.g., a mouse or chicken framework sequence). In many embodiments, provided construct comprise or are human antibodies (e.g., a human monoclonal antibody or fragment thereof, human antigen-binding protein or polypeptide, human multispecific antibody (e.g., a human bispecific antibody), a human polypeptide having one or more structural components of a human immunoglobulin polypeptide).

In one aspect, the invention features an anti-CD22 construct comprising an antibody moiety that specifically binds to CD22, wherein the antibody moiety comprises: (a) a light chain variable region (VL) comprising a light chain complementarity determining region (LC-CDR) 1, an LC-CDR2, and an LC-CDR3 of the light chain variable region of SEQ ID NO: 218 or 212; and (b) a heavy chain variable region ($V_H$) comprising a heavy chain complementarity determining region (HC-CDR) 1, an HC-CDR2, and an HC-CDR3 of the heavy chain variable region of SEQ ID NO: 219 or 213.

In some embodiments, the antibody moiety comprises the LC-CDR1, the LC-CDR2, and the LC-CDR3 of the light chain variable region of SEQ ID NO: 218. In some embodiments, the antibody moiety comprises the LC-CDR1, the LC-CDR2, and the LC-CDR3 of the light chain variable region of SEQ ID NO: 212.

In some embodiments, the antibody moiety comprises: (a) the light chain variable region (VL) comprising the LC-CDR1, the LC-CDR2, and the LC-CDR3 of the light chain variable region of SEQ ID NO: 218; and (b) a heavy chain variable region (VH) comprising the HC-CDR1, the HC-CDR2, and the HC-CDR3 of the heavy chain variable region of SEQ ID NO: 219.

In some embodiments, the antibody moiety comprises: (a) the light chain variable region (VL) comprising the LC-CDR1, the LC-CDR2, and the LC-CDR3 of the light chain variable region of SEQ ID NO: 212; and (b) a heavy chain variable region (VH) comprising the HC-CDR1, the HC-CDR2, and the HC-CDR3 of the heavy chain variable region of SEQ ID NO: 213.

In some embodiments of this aspect, the antibody moiety comprises one or more of: the LC-CDR1 having a sequence of HDIRNY (SEQ ID NO: 214), the LC-CDR2 having a sequence of AAS (SEQ ID NO: 215), the LC-CDR3 having a sequence of QQYDGLPLT (SEQ ID NO: 216), the HC-CDR1 having a sequence of GFTFSNYA (SEQ ID NO: 209), the HC-CDR2 having a sequence of ISGSGGST (SEQ ID NO: 210), and the HC-CDR3 having a sequence of ARYGSAAWMDS (SEQ ID NO: 217). In particular embodiments, the antibody moiety comprises the sequences of SEQ ID NOS: 209, 210, and 214-217.

In some embodiments of this aspect, the light chain variable region has a sequence having at least 90% identity to the sequence of DIQLTQSPSSLSTSVGDRVTITCQASHDIR-NYLNWYQQKPGKAPNLLIYAASNLQTGV PSRFS-GRGSGTDFTLTIS SLQPEDIATYYCQQYDG-LPLTFGQGTRLEIKR (SEQ ID NO: 218).

In some embodiments of this aspect, the heavy chain variable region has a sequence having at least 90% identity to the sequence of QVQLVESGGGLVQPGGSLRLS-CAASGFTF SNYAMSWVRQAPGKGLEWVSSISGSGG STYYADSVKGRFTISRDTSKNTLYLQMNSLRAED-TAVYYCARYGSAAWMDSWGQG TLVTVSS (SEQ ID NO: 219).

In another aspect, the invention features an anti-CD22 construct comprising a light chain variable region and a heavy chain variable region, wherein the light chain variable region has a sequence having at least 90% identity (e.g., at least 92%, 94%, 96%, 98%, or 99% identity) to the sequence of DIQLTQSPSSLSTSVGDRVTITCQASHDIR- NYLNWYQQKPGKAPNLLIYAASNLQTGVPSRFSGRGSGTDFTLTISSLQPEDIATYYCQQYDGLPLTFGQGTRLEIKR (SEQ ID NO: 218), and the heavy chain variable region has a sequence having at least 90% identity (e.g., at least 92%, 94%, 96%, 98%, or 99% identity) to the sequence of QVQLVESGGGLVQPGGSLRLSCAASGFTF SNYAMSWVRQAPGKGLEWVSSISGSGG STYYADSVKGRFTISRDTSKNTLYLQMNSLRAEDTAVYYCARYGSAAWMDSWGQGTLVTVSS (SEQ ID NO: 219). In some embodiments, the light chain variable region comprises the sequence of SEQ ID NO: 218, and the heavy chain variable region comprises the sequence of SEQ ID NO: 219.

In some embodiments of the first aspect of the invention, the antibody moiety comprises one or more of: the LC-CDR1 having a sequence of SSNIGNNY (SEQ ID NO: 206), the LC-CDR2 having a sequence of ENN (SEQ ID NO: 207), the LC-CDR3 having a sequence of GTWDSSLSAGAV (SEQ ID NO: 208), the HC-CDR1 having a sequence of GFTFSNYA (SEQ ID NO: 209), the HC-CDR2 having a sequence of ISGSGGST (SEQ ID NO: 210), and the HC-CDR3 having a sequence of ARPYYDD (SEQ ID NO: 211). In some embodiments, the antibody moiety comprises the sequences of SEQ ID NOS: 206-211.

In some embodiments of this aspect, the light chain variable region of the construct has a sequence having at least 90% identity (e.g., at least 92%, 94%, 96%, 98%, or 99% identity) to the sequence of QSVVTQPPSVSAAPGQKVTISCSGSSSNIGNNYVSWYQQLPGTAPKLLIYENNKRPSGIPDRFSGSKSGTSATLGITGLQTGDEADYYCGTWDSSLSAGAVFGGGTKLTVLG (SEQ ID NO: 212). In some embodiments, the heavy chain variable region has a sequence having at least 90% identity (e.g., at least 92%, 94%, 96%, 98%, or 99% identity) to the sequence of EVQLVESGGGLVQPGGSLRLSCAASGFTF SNYAMSWVRQAPGKGLEWVSAISGSGG STYYADSVKGRFTISRDNSKNTLYLQMNSLRAEDTAVYYCARPYYDDWGQGTLVT VSS (SEQ ID NO: 213). In some embodiments, the light chain variable region comprises the sequence of SEQ ID NO: 212, and the heavy chain variable region comprises the sequence of SEQ ID NO: 213.

In another aspect, the invention provides an anti-CD22 construct comprising an antibody moiety that competes with an anti-CD22 construct described herein for specific binding to CD22.

In another aspect, the invention provides an anti-CD22 construct comprising a heavy chain variable region and a light chain variable region and, wherein the light chain variable region has a sequence having at least 90% identity (e.g., at least 92%, 94%, 96%, 98%, or 99% identity) to the sequence of QSVVTQPPSVSAAPGQKVTISCSGSSSNIGNNYVSWYQQLPGTAPKLLIYENNKRPSGIPDRFSGSKSGTSATLGITGLQTGDEADYYCGTWDSSLSAGAVFGGGTKLTVLG (SEQ ID NO: 212), and the heavy chain variable region has a sequence having at least 90% identity (e.g., at least 92%, 94%, 96%, 98%, or 99% identity) to the sequence of EVQLVESGGGLVQPGGSLRLSCAASGFTF SNYAMSWVRQAPGKGLEWVSAISGSGG STYYAD SVKGRFTISRDNSKNTLYLQMNSLRAEDTAVYYCARPYYDDWGQGTLVT VSS (SEQ ID NO: 213). In particular embodiments, the anti-CD22 construct has a light chain variable region sequence of SEQ ID NO: 212 and a heavy chain variable region sequence of SEQ ID NO: 213.

In some embodiments, the light chain variable region and the heavy chain variable region are joined by a linker (e.g., a linker having the sequence of SRGGGGSGGGGSGGGGSLEMA (SEQ ID NO: 233).

In some embodiments, the construct comprises a light chain of the lambda or kappa isotype.

In any of the aspects described herein, the anti-CD22 construct binds to a an extracellular region of CD22. In particular embodiments, the extracellular region of CD22 comprises at least 7 amino acids of the sequence of DVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVS LQCDFSSSHPKEVQFFWEKNGRLLGKESQLNFDSISPEDAGSYSCWVNNSIGQTASK AWTLEVLYAPRRLRVSMSPGDQVMEGKSATLTCESDANPPVSHYTWFDWNNQSLP YHSQKLRLEPVKVQHSGAYWCQGTNSVGKGRSPLSTLTVYYSPETIGRR (SEQ ID NO: 205). In particular embodiments, the extracellular region has the sequence of SEQ ID NO: 205.

In some embodiments of any of the aspects described herein, the anti-CD22 construct is a full-length antibody, a Fab, a Fab', a F(ab')2, an Fv, a single chain Fv (scFv) antibody. In some embodiments, the anti-CD22 construct is monospecific. In some embodiments, the anti-CD22 construct is multispecific (e.g., bispecific).

In some embodiments of any of the aspects described herein, the anti-CD22 construct further comprises a second antibody moiety that specifically binds to a second antigen. The second antigen may be an antigen on the surface of a T cell (e.g., a cytotoxic T cell, a helper T cell, or a natural killer T cell). In some embodiments, the second antigen is selected from the group consisting of CD3γ, CD3δ, CD3ε, CD3ζ, CD28, CD16a, CD56, CD68, GDS2D, OX40, GITR, CD137, CD27, CD40L and HVEM. In some embodiments, the second antigen is an antigen on the surface of a natural killer cell, a neutrophil, a monocyte, a macrophage or a dendritic cell.

In particular embodiments, the second antigen is CD3ε, and wherein the construct is a tandem scFv comprising an N-terminal scFv specific for CD22 having the sequence of SEQ ID NO: 205 or a portion thereof and a C-terminal scFv specific for CD3ε.

In some embodiments of any of the aspects described herein, the anti-CD22 construct is a tandem scFv, a diabody (Db), a single chain diabody (scDb), a dual-affinity retargeting (DART) antibody, a dual variable domain (DVD) antibody, a knob-into-hole (KiH) antibody, a dock and lock (DNL) antibody, a chemically cross-linked antibody, a heteromultimeric antibody, or a heteroconjugate antibody. In particular embodiments, the anti-CD22 construct is a tandem scFv comprising two scFvs linked by a peptide linker (e.g., the peptide linker comprises the amino acid sequence of SEQ ID NO: 233).

In some embodiments of any of the aspects described herein, the construct is a chimeric antigen receptor (CAR). In some embodiments, the CAR comprises an anti-CD22 antibody moiety, a transmembrane domain (e.g., a T cell receptor transmembrane domain), and an immune cell signaling domain, wherein the anti-CD22 antibody moiety is a scFv comprising the LC-CDR1, the LC-CDR2, and the LC-CDR3 having the sequences of SEQ ID NOS: 214-216, respectively, the HC-CDR1, the HC-CDR2, and the HC-CDR3 having the sequences of SEQ ID NOS: 209, 210, and 217, respectively. In some embodiments, the CAR comprises an anti-CD22 antibody moiety, a transmembrane domain, and an immune cell signaling domain, wherein the anti-CD22 antibody moiety is a scFv comprising the LC-CDR1, the LC-CDR2, and the LC-CDR3 having the sequences of SEQ ID NOS: 206-208, respectively, the HC-CDR1, the HC-CDR2, and the HC-CDR3 having the sequences of SEQ ID NOS: 209-211, respectively. In some embodiments, the immune cell signaling domain is from a CD3ζ chain. In other embodiments, the immune cell signaling domain is from CD28, 4-1BB, ICOS, or OX40.

In some embodiments of any of the aspects described herein, the construct is a chimeric antibody-T cell receptor (caTCR, which is also named antibody-TCR chimeric molecule or construct (abTCR)) comprising an extracellular domain that binds to CD22 (e.g., SEQ ID NO: 205 or a portion thereof) and a T cell receptor (TCR) module (TCRM) comprising TCR transmembrane domains. In some embodiments, the caTCR comprises LC-CDR1, LC-CDR2, and LC-CDR3 having the sequences of SEQ ID NOS: 214-216, respectively, and HC-CDR1, HC-CDR2, and HC-CDR3 having the sequences of SEQ ID NOS: 209, 210, and 217, respectively. In other embodiments, the caTCR comprises LC-CDR1, LC-CDR2, and LC-CDR3 having the sequences of SEQ ID NOS: 206-208, respectively, and HC-CDR1, HC-CDR2, and HC-CDR3 having the sequences of SEQ ID NOS: 209-211, respectively. In some embodiments, the TCRM is capable of recruiting at least one TCR-associated signaling module (e.g., CD3δε, CD3γε, and CD3ζ).

In some embodiments, the extracellular domain of the caTCR comprises: (a) a first polypeptide comprising a first antigen-binding region comprising a heavy chain variable region (VH) and a $C_H1$ antibody constant domain; and (b) a second polypeptide chain comprising a second antigen-binding region comprising a light chain variable region (VL) and a $C_L$ antibody constant domain, wherein the $V_H$ and the $C_H1$ antibody constant domain of the first antigen-binding region and the $V_L$ and the $C_L$ antibody constant domain of the second antigen-binding region form a Fab-like antigen-binding module that specifically binds to CD22.

In some embodiments, the extracellular domain comprises a scFv that specifically binds to CD22. In some embodiments, the extracellular domain further comprises at least one additional antibody moiety that specifically binds to at least one non-CD22 antigen. In some embodiments, the at least one non-CD22 antigen is expressed in B-cell malignancy. In particular embodiments, the extracellular domain further comprises an antibody moiety that specifically binds to CD19. In particular embodiments, the extracellular domain further comprises an antibody moiety that specifically binds to CD20. In particular embodiments, the extracellular domain further comprises an antibody moiety that specifically binds to CD19 and an antibody moiety that specifically binds to CD20.

In some embodiments, the caTCR is expressed in combination with a chimeric signaling receptor (CSR). In some embodiments, the CSR comprises an anti-CD22 antibody moiety. In some embodiments, the CSR comprises an antibody moiety that specifically binds a non-CD22 antigen.

In some embodiments of any of the aspects described herein, the construct is a chimeric signaling receptor (CSR). In some embodiments, the CSR comprises (a) an anti-CD22 antibody moiety; (b) a transmembrane module; and (c) a co-stimulatory immune cell signaling module that is capable of providing a co-stimulatory signal to the immune cell, wherein the CSR lacks a functional primary immune cell signaling domain. In particular embodiments, the anti-CD22 antibody moiety comprises the LC-CDR1, the LC-CDR2, and the LC-CDR3 having the sequences of SEQ ID NOS: 214-216, respectively, the HC-CDR1, the HC-CDR2, and the HC-CDR3 having the sequences of SEQ ID NOS: 209, 210, and 217, respectively. In particular embodiments, the anti-CD22 antibody moiety comprises the LC-CDR1, the LC-CDR2, and the LC-CDR3 having the sequences of SEQ ID NOS: 206-208, respectively, the HC-CDR1, the HC-CDR2, and the HC-CDR3 having the sequences of SEQ ID NOS: 209-211, respectively. In some embodiments, the CSR is used (i.e., expressed) in combination with a caTCR or CAR. In some embodiments, the CSR is expressed in combination with a caTCR or CAR.

In some embodiments, the CSR is expressed in combination with a caTCR or CAR that specifically targets CD22. In other embodiments, the CSR is expressed in combination with a caTCR or CAR that does not specifically target CD22.

In some embodiments, the CSR further comprises at least one additional antibody moiety that specifically binds to at least one non-CD22 antigen. In particular embodiments, the CSR further comprises an antibody moiety that specifically binds to CD19. In particular embodiments, the CSR further comprises an antibody moiety that specifically binds to CD20.

In some embodiments, the CSR comprises a transmembrane fragment and an intracellular fragment that are from the same molecule. In particular embodiments, the molecule is selected from the group consisting of CD28, 4-1BB (CD137), OX40, CD30, CD27, CD40, PD-1, ICOS, lymphocyte function-associated antigen-1 (LFA-1), CD2, CD7, LIGHT, NKG2C, B7-H3, and a ligand that specifically binds with CD83. In particular embodiments, the molecule is selected from the group consisting of CD28, 4-1BB (CD137), OX40, CD30, and CD27.

In other embodiments, the CSR comprises a transmembrane fragment and an intracellular fragment that are from different molecules. In some embodiments, the CSR comprises a transmembrane fragment of a molecule selected from the group consisting of the α, β, δ, γ, or ζ chain of the T-cell receptor, CD28, CD3ε, CD3ζ, CD45, CD4, CD5, CD8, CD9, CD16, CD22, CD33, CD37, CD64, CD80, CD86, CD134, CD137, and CD154 (e.g., a transmembrane fragment of CD8, 4-1BB, CD27, CD28, CD30, or OX40). In particular embodiments, the transmembrane fragment comprises a sequence of any one of SEQ ID NOS: 145-150. In some embodiments, the CSR comprises an intracellular fragment of a molecule selected from the group consisting of CD28, 4-1BB (CD137), OX40, CD30, CD27, CD40, PD-1, ICOS, lymphocyte function-associated antigen-1 (LFA-1), CD2, CD7, LIGHT, NKG2C, B7-H3, and a ligand that specifically binds with CD83 (e.g., an intracellular fragment of a molecule selected from the group consisting of CD28, 4-1BB (CD137), OX40, CD30, and CD27). In particular embodiments, the intracellular fragment comprises a sequence of any one of SEQ ID NOS: 151-155. In other embodiments, the CSR comprises a sequence of any one of SEQ ID NOS: 156-171.

In some embodiments of any of the aspects described herein, the anti-CD22 construct is an immunoconjugate comprising the antibody moiety and an effector molecule. An effector molecule may be a therapeutic agent selected from the group consisting of a drug, a toxin, a radioisotope, a protein, a peptide, and a nucleic acid (e.g., a drug or a toxin). In some embodiments, an effector molecule may be a label.

In another aspect, the invention provides a nucleic acid molecule encoding one or more polypeptides contained in an anti-CD22 construct described herein. For example, a nucleic acid molecule may encode a light chain variable region (e.g., SEQ ID NO: 212 or 218) or a heavy chain variable region (e.g., SEQ ID NO: 213 or 219) of the construct. In some embodiments, the nucleic acid molecule may encode an scFv antibody (e.g., SEQ ID NO: 239 or 240). In further embodiments, different polypeptides in an anti-CD22 construct described herein (e.g., an anti-CD22 CAR or an caTCR) may be encoded by multiple separate nucleic acid molecules. For examples, two polypeptides in an anti-CD22 construct described herein (e.g., an anti-CD22 CAR or an caTCR) may be encoded by two separate nucleic acid molecules. In some embodiments, the nucleic acid molecule encodes all of the polypeptides contained in an anti-CD22 construct described herein.

In some embodiments of this aspect, the anti-CD22 construct is a caTCR and is expressed in combination with a CSR, and wherein the nucleic acid molecule encodes all of the polypeptides contained in the caTCR and the polypeptide of the CSR; or the anti-CD22 construct is a CSR and is expressed in combination with a caTCR or CAR, and wherein the nucleic acid molecule encodes the polypeptide of the CSR and all of the polypeptides contained in the caTCR or CAR.

In another aspect, the invention provides a set of nucleic acid molecules encoding all of the polypeptides contained in an anti-CD22 construct described herein separately.

In some embodiments of this aspect, the anti-CD22 construct is a caTCR and is expressed in combination with a CSR, and wherein the set of nucleic acid molecules encode all of the polypeptides contained in the caTCR and the polypeptide of the CSR; or the anti-CD22 construct is a CSR and is expressed in combination with a caTCR or CAR, and wherein the set of nucleic acid molecules encode the polypeptide of the CSR and all of the polypeptides contained in the caTCR or CAR.

In another aspect, the invention also provides an expression cassette comprising the nucleic acid molecule described above, operably linked to a promoter, which in some cases is heterologous to the coding sequence within the nucleic acid. When multiple separate nucleic acid molecules are used to encode multiple polypeptides in an anti-CD22 construct described herein, the multiple separate nucleic acid molecules may be placed in multiple expression cassettes.

In another aspect, the invention provides a set of expression cassettes comprising nucleic acid molecules encoding all of the polypeptides contained in the anti-CD22 construct described herein separately. In some embodiments, the set of expression cassettes comprise the set of nucleic acid molecules described above.

In another aspect, the invention provides a host cell comprising the nucleic acid molecule, the set of nucleic acid molecules, the expression cassette, or the set of expression cassettes described above.

In another aspect, the invention provides a host cell expressing the anti-CD22 construct described herein. In some embodiments, the host cell comprises the nucleic acid molecule, the set of nucleic acid molecules, the expression cassette, or the set of expression cassettes described herein.

In another aspect, the invention provides a method of preparing an anti-CD22 construct described herein, wherein said method comprising: (a) providing a host cell comprising the nucleic acid molecule, the set of nucleic acid molecules, the expression cassette, or the set of expression cassettes described above, and b) expressing the nucleic acid molecule(s) or the expression cassette(s) in the host cell under conditions that allow for the formation of the anti-CD22 construct.

In another aspect, the invention provides a pharmaceutical composition comprising an anti-CD22 construct described above, a nucleic acid encoding one or more polypeptides contained in an anti-CD22 construct described above, a set of nucleic acid molecules encoding one or more polypeptides contained in an anti-CD22 construct described above, an expression cassette comprising the nucleic acid molecule, a set of expression cassettes comprising multiple nucleic acid molecules, or a host cell expressing an anti-CD22 construct, and one or more pharmaceutically acceptable carriers or excipients. In some embodiments, the construct in the pharmaceutical composition is in a therapeutically effective amount.

In another aspect, the invention provides a method of treating a B-cell malignancy in a subject in need thereof, comprising administering to the subject a therapeutically effective amount of an anti-CD22 construct, a nucleic acid molecule, a set of nucleic acid molecules, an expression cassette, a set of expression cassettes, a host cell, or a pharmaceutical composition described herein.

In another aspect, the invention provides a method of treating a disease or disorder characterized by CD22 overexpression in a subject in need thereof, comprising administering to the subject a therapeutically effective amount of an anti-CD22 construct, a nucleic acid molecule, a set of nucleic acid molecules, an expression cassette, a set of expression cassettes, a host cell, or a pharmaceutical composition described herein. In some embodiments, the method is a method of treating a disease. In some embodiments, the method is a method of treating a disorder. In some embodiments, the disease or disorder characterized by CD22 overexpression is cancer (e.g., B-cell malignancy).

In another aspect, the invention provides a method of treatment comprising introducing the nucleic acid molecule, the set of nucleic acid molecules, the expression cassette, or the set of expression cassettes into one or more primary cells isolated from a subject and administering cells comprising the one or more nucleic acids to the subject. In some embodiments, the method further comprises expanding the cells prior to administering the cells to the subject. In some embodiments, the primary cells are lymphocytes. In some embodiments, the primary cells are T cells.

In another aspect, the invention provides a method of detecting CD22 in a sample, comprising: (a) contacting the sample with an anti-CD22 construct described herein; and (b) detecting the binding, directly or indirectly, between the anti-CD22 construct and any CD22 in the sample. In some embodiments, the anti-CD22 construct is conjugated to a detectable label (e.g., a chromogenic, enzymatic, radioisotopic, isotopic, fluorescent, toxic, chemiluminescent, or nuclear magnetic resonance contrast agent). In some embodiments, the binding between the anti-CD22 construct and any CD22 in the sample is detected directly by detecting the detectable label. In other embodiments, the binding between the anti-CD22 construct and any CD22 in the sample is detected indirectly using a secondary antibody.

In another aspect, the invention provides a method of diagnosing a subject suspected of having a CD22-associated disease or disorder, comprising: a) administering an effective amount of an anti-CD22 construct described herein to the subject; and b) determining the level of the binding, directly or indirectly, between the anti-CD22 construct and any CD22 in the subject, wherein a level of the binding above a threshold level indicates that the subject has the CD22-associated disease or disorder.

In some embodiments of the methods described herein, the CD22-associated disease or disorder is cancer (e.g., B-cell malignancy).

In another aspect, the invention provides a method of diagnosing a subject having a B-cell malignancy, comprising: (a) contacting a sample derived from the subject with the anti-CD22 construct described herein; and (b) determining the number of cells bound with the anti-CD22 construct in the sample, wherein a value for the number of cells bound with the anti-CD22 construct above a threshold level indicates that the subject has the B-cell malignancy.

In some embodiments of any of the methods described herein, the disease, disorder, or B-cell malignancy is a B-cell lymphoma or a B-cell leukemia. In some embodiments, the B-cell malignancy is a CD22$^+$ B-cell malignancy or a B-cell related cancer. In some embodiments, the B-cell malignancy is a B-cell lymphoma (e.g., a CD22$^+$ B-cell lymphoma) or a B-cell leukemia (e.g., a CD22$^+$ B-cell leukemia). In particular embodiments, a B-cell malignancy (e.g., a CD22$^+$ B-cell malignancy) is selected from the group consisting of acute lymphoblastic leukemia (ALL), Hodgkin's lymphoma, non-Hodgkin's lymphoma, B cell chronic lymphocytic leukemia (CLL), multiple myeloma, follicular lymphoma, mantle cell lymphoma, pro-lymphocytic leukemia, hairy cell leukemia, common acute lymphocytic leukemia, and null-acute lymphoblastic leukemia. In some embodiments of any of the methods described herein, the subject is human.

In another aspect, the invention provides a use of the anti-CD22 construct, the nucleic acid molecule, the set of nucleic acid molecules, the expression cassette, the set of expression cassettes, the host cell, or the pharmaceutical composition described herein for the treatment of a disease or disorder associated with positive CD22 expression.

In another aspect, the invention provides a use of the anti-CD22 construct, the nucleic acid molecule, the set of nucleic acid molecules, the expression cassette, the set of expression cassettes, the host cell, or the pharmaceutical composition described herein in the manufacture of a medicament for the treatment of a disease or disorder associated with positive CD22 expression.

In another aspect, the invention provides a use of the anti-CD22 construct described herein for the diagnosis of a disease or disorder associated with positive CD22 expression. In some embodiments, the disease or disorder associated with positive CD22 expression is a cancer.

Definitions

The scope of present invention is defined by the claims appended hereto and is not limited by particular embodiments described herein; those skilled in the art, reading the present disclosure, will be aware of various modifications that may be equivalent to such described embodiments, or otherwise within the scope of the claims.

In general, terminology used herein is in accordance with its understood meaning in the art, unless clearly indicated otherwise. Explicit definitions of certain terms are provided below; meanings of these and other terms in particular instances throughout this specification will be clear to those skilled in the art from context.

In order that the present invention may be more readily understood, certain terms are first defined below. Additional definitions for the following terms and other terms are set forth throughout the specification.

Administration: As used herein, the term "administration" refers to the administration of a composition to a subject or system (e.g., to a cell, organ, tissue, organism, or relevant component or set of components thereof). Those of ordinary skill will appreciate that route of administration may vary depending, for example, on the subject or system to which the composition is being administered, the nature of the composition, the purpose of the administration, etc. For example, in certain embodiments, administration to an animal subject (e.g., to a human) may be bronchial (including by bronchial instillation), buccal, enteral, interdermal, intra-arterial, intradermal, intragastric, intrahepatic, intramedullary, intramuscular, intranasal, intraperitoneal, intrathecal, intratumoral, intravenous, intraventricular, mucosal, nasal, oral, rectal, subcutaneous, sublingual, topical, tracheal (including by intratracheal instillation), transdermal, vaginal and/or vitreal. In some embodiments, administration may involve intermittent dosing. In some embodiments, administration may involve continuous dosing (e.g., perfusion) for at least a selected period of time.

Affinity: As is known in the art, "affinity" is a measure of the tightness with a particular ligand binds to its partner. Affinities can be measured in different ways. In some embodiments, affinity is measured by a quantitative assay. In some such embodiments, binding partner concentration may be fixed to be in excess of ligand concentration so as to mimic physiological conditions. Alternatively or additionally, in some embodiments, binding partner concentration and/or ligand concentration may be varied. In some such embodiments, affinity may be compared to a reference under comparable conditions (e.g., concentrations).

Affinity matured (or affinity matured antibody): As used herein, refers to an antibody with one or more alterations in one or more CDRs (or, in some embodiments, framework regions) thereof which result an improvement in the affinity of the antibody for antigen, compared to a parent antibody which does not possess those alteration(s). In some embodiments, affinity matured antibodies will have nanomolar or even picomolar affinities for a target antigen. Affinity matured antibodies may be produced by any of a variety of procedures known in the art. Marks et al., 1992, *BioTechnology* 10: 779-783 describes affinity maturation by $V_H$ and $V_L$ domain shuffling. Random mutagenesis of CDR and/or framework residues is described by: Barbas et al., 1994, *Proc. Nat. Acad. Sci.*, U.S.A. 91: 3809-3813; Schier et al., 1995, *Gene* 169: 147-155; Yelton et al., 1995. *J. Immunol.* 155: 1994-2004; Jackson et al., 1995, *J. Immunol.* 154(7): 3310-9; and Hawkins et al., 1992, *J. Mol. Biol.* 226: 889-896. Selection of binders with improved binding properties is described by Thie et al., 2009, *Methods Mol. Bio.* 525: 309-22.

Agent: As used herein may refer to a compound or entity of any chemical class including, for example, polypeptides, nucleic acids, saccharides, lipids, small molecules, metals, or combinations thereof. In some embodiments, an agent is or comprises a natural product in that it is found in and/or is obtained from nature. In some embodiments, an agent is or comprises one or more entities that is man-made in that it is designed, engineered, and/or produced through action of the hand of man and/or is not found in nature. In some embodiments, an agent may be utilized in isolated or pure form; in some embodiments, an agent may be utilized in crude form. In some embodiments, potential agents are provided as collections or libraries, for example that may be screened to identify or characterize active agents within them. Some particular embodiments of agents that may be utilized in accordance with the present invention include small molecules, antibodies, aptamers, nucleic acids (e.g., siRNAs, shRNAs, DNA/RNA hybrids, antisense oligonucleotides, ribozymes), peptides, peptide mimetics, etc. In some embodiments, an agent is or comprises a polymer. In some embodiments, an agent is not a polymer and/or is substantially free of any polymer. In some embodiments, an agent contains at least one polymeric moiety. In some embodiments, an agent lacks or is substantially free of any polymeric moiety.

Amino acid: As used herein, term "amino acid," in its broadest sense, refers to any compound and/or substance that can be incorporated into a polypeptide chain. In some embodiments, an amino acid has the general structure H$_2$N—C(H)(R)—COOH. In some embodiments, an amino acid is a naturally occurring amino acid. In some embodiments, an amino acid is a synthetic amino acid; in some embodiments, an amino acid is a d-amino acid; in some embodiments, an amino acid is an l-amino acid. "Standard amino acid" refers to any of the twenty standard l-amino acids commonly found in naturally occurring peptides. "Nonstandard amino acid" refers to any amino acid, other than the standard amino acids, regardless of whether it is prepared synthetically or obtained from a natural source. As used herein, "synthetic amino acid" encompasses chemically modified amino acids, including but not limited to salts, amino acid derivatives (such as amides), and/or substitutions. Amino acids, including carboxy- and/or amino-terminal amino acids in peptides, can be modified by methylation, amidation, acetylation, protecting groups, and/or substitution with other chemical groups that can change the peptide's circulating half-life without adversely affecting their activity. Amino acids may participate in a disulfide bond. Amino acids may comprise one or post-translational modifications, such as association with one or more chemical entities (e.g., methyl groups, acetate groups, acetyl groups, phosphate groups, formyl moieties, isoprenoid groups, sulfate groups, polyethylene glycol moieties, lipid moieties, carbohydrate moieties, biotin moieties, etc.). The term "amino acid" is used interchangeably with "amino acid residue," and may refer to a free amino acid and/or to an amino acid residue of a peptide. It will be apparent from the context in which the term is used whether it refers to a free amino acid or a residue of a peptide.

Animal: As used herein refers to any member of the animal kingdom. In some embodiments, "animal" refers to humans, of either sex and at any stage of development. In some embodiments, "animal" refers to non-human animals, at any stage of development. In certain embodiments, the non-human animal is a mammal (e.g., a mouse, a rat, a rabbit, a pig, a cow, a deer, a sheep, a goat, a cat, a dog, or a monkey). In some embodiments, animals include, but are not limited to, mammals, birds, reptiles, amphibians, fish, insects, and/or worms. In some embodiments, an animal may be a transgenic animal, genetically engineered animal, and/or a clone.

Antibody moiety: As used herein, this term encompasses full-length antibodies and antigen-binding fragments thereof. A full-length antibody comprises two heavy chains and two light chains. The variable regions of the light and heavy chains are responsible for antigen binding. The variable regions in both chains generally contain three highly variable loops called the complementarity determining regions (CDRs) (light chain (LC) CDRs including LC-CDR1, LC-CDR2, and LC-CDR3, heavy chain (HC) CDRs including HC-CDR1, HC-CDR2, and HC-CDR3). CDR boundaries for the antibodies and antigen-binding fragments disclosed herein may be defined or identified by the conventions of Kabat, Chothia, or Al-Lazikani (Al-Lazikani 1997; Chothia 1985; Chothia 1987; Chothia 1989; Kabat 1987; Kabat 1991). The three CDRs of the heavy or light chains are interposed between flanking stretches known as framework regions (FRs), which are more highly conserved than the CDRs and form a scaffold to support the hypervariable loops. The constant regions of the heavy and light chains are not involved in antigen binding, but exhibit various effector functions. Antibodies are assigned to classes based on the amino acid sequence of the constant region of their heavy chain. The five major classes or isotypes of antibodies are IgA, IgD, IgE, IgG, and IgM, which are characterized by the presence of α, δ, ε, γ, and μ heavy chains, respectively. Several of the major antibody classes are divided into subclasses such as lgG1 (γ1 heavy chain), lgG2 (γ2 heavy chain), lgG3 (γ3 heavy chain), lgG4 (γ4 heavy chain), lgA1 (α1 heavy chain), or lgA2 (α2 heavy chain).

Antigen-binding fragment or Antigen-binding portion: The term "antigen-binding fragment" or "antigen-binding portion," as used herein, refers to an antibody fragment including, for example, a diabody, a Fab, a Fab', a F(ab')2, an Fv fragment, a disulfide stabilized Fv fragment (dsFv), a (dsFv)2, a bispecific dsFv (dsFv-dsFv'), a disulfide stabilized diabody (ds diabody), a single-chain Fv (scFv), an scFv dimer (bivalent diabody), a multispecific antibody formed from a portion of an antibody comprising one or more CDRs, a camelized single domain antibody, a nanobody, a domain antibody, a bivalent domain antibody, or any other antibody fragment that binds to an antigen but does not comprise a complete antibody structure. An antigen-binding fragment is capable of binding to the same antigen to which the parent antibody or a parent antibody fragment (e.g., a parent scFv) binds. In some embodiments, an antigen-binding fragment may comprise one or more CDRs from a particular human antibody grafted to a framework region from one or more different human antibodies.

Biological activity: As used herein, refers to an observable biological effect or result achieved by an agent or entity of interest. For example, in some embodiments, a specific binding interaction is a biological activity. In some embodiments, modulation (e.g., induction, enhancement, or inhibition) of a biological pathway or event is a biological activity. In some embodiments, presence or extent of a biological activity is assessed through detection of a direct or indirect product produced by a biological pathway or event of interest.

Bispecific antibody: As used herein, refers to a bispecific binding agent in which at least one, and typically both, of the binding moieties is or comprises an antibody moiety. A variety of different bispecific antibody structures are known in the art. In some embodiments, each binding moiety in a bispecific antibody that is or comprises an antibody moiety includes $V_H$ and/or $V_L$ regions; in some such embodiments, the $V_H$ and/or $V_L$ regions are those found in a particular monoclonal antibody. In some embodiments, where the bispecific antibody contains two antibody moieties, each includes $V_H$ and/or $V_L$ regions from different monoclonal antibodies.

The term "bispecific antibody" as used herein also refers to a polypeptide with two discrete binding moieties, each of which binds a distinct target. In some embodiments, a bispecific binding antibody is a single polypeptide; in some embodiments, a bispecific binding antibody is or comprises a plurality of peptides which, in some such embodiments may be covalently associated with one another, for example by cross-linking. In some embodiments, the two binding moieties of a bispecific binding antibody recognize different sites (e.g., epitopes) of the same target (e.g., antigen); in some embodiments, they recognize different targets. In some embodiments, a bispecific binding antibody is capable of binding simultaneously to two targets, which are of different structure.

Carrier: As used herein, refers to a diluent, adjuvant, excipient, or vehicle with which a composition is administered. In some exemplary embodiments, carriers can include sterile liquids, such as, for example, water and oils, including oils of petroleum, animal, vegetable or synthetic origin, such as, for example, peanut oil, soybean oil, mineral oil, sesame oil and the like. In some embodiments, carriers are or include one or more solid components.

CDR: As used herein, the term "CDR" or "complementarity determining region" is intended to mean the non-contiguous antigen combining sites found within the variable region of both heavy and light chain polypeptides. There are three CDRs in each of the variable regions of the heavy chain and the light chain, which are designated CDR1, CDR2 and CDR3, for each of the variable regions. A "set of CDRs" or "CDR set" refers to a group of three or six CDRs that occur in either a single variable region capable of binding the antigen or the CDRs of cognate heavy and light chain variable regions capable of binding the antigen. These particular regions have been described by Kabat et al., *J. Biol. Chem.* 252: 6609-6616 (1977); Kabat et al., *U.S. Dept. of Health and Human Services*, "Sequences of proteins of immunological interest" (1991); Chothia et al., *J. Mol. Biol.* 196: 901-917 (1987); Al-Lazikani B. et al., *J. Mol. Biol.*, 273: 927-948 (1997); MacCallum et al., *J. Mol. Biol.* 262: 732-745 (1996); Abhinandan and Martin, *Mol. Immunol.*, 45: 3832-3839 (2008); Lefranc M. P. et al., *Dev. Comp. Immunol.*, 27: 55-77 (2003); and Honegger and Pluckthun, *J. Mol. Biol.*, 309: 657-670 (2001), where the definitions include overlapping or subsets of amino acid residues when compared against each other. Nevertheless, application of either definition to refer to a CDR of an antibody or grafted antibodies or variants thereof is intended to be within the scope of the term as defined and used herein. The amino acid residues which encompass the CDRs as defined by each of the above cited references are set forth below in Table 1 as a comparison. CDR prediction algorithms and interfaces are known in the art, including, for example, Abhinandan and Martin, *Mol. Immunol.*, 45: 3832-3839 (2008); Ehrenmann F. et al., *Nucleic Acids Res.*, 38: D301-D307 (2010); and Adolf-Bryfogle J. et al., *Nucleic Acids Res.*, 43: D432-D438 (2015). The contents of the references cited in this paragraph are incorporated herein by reference in their entireties for use in the present invention and for possible inclusion in one or more claims herein.

TABLE 1

|  | Kabat[1] | Chothia[2] | MacCallum[3] | IMGT[4] | AHo[5] |
|---|---|---|---|---|---|
| $V_H$ CDR1 | 31-35 | 26-32 | 30-35 | 27-38 | 25-40 |
| $V_H$ CDR2 | 50-65 | 53-55 | 47-58 | 56-65 | 58-77 |
| $V_H$ CDR3 | 95-102 | 96-101 | 93-101 | 105-117 | 109-137 |
| $V_L$ CDR1 | 24-34 | 26-32 | 30-36 | 27-38 | 25-40 |
| $V_L$ CDR2 | 50-56 | 50-52 | 46-55 | 56-65 | 58-77 |
| $V_L$ CDR3 | 89-97 | 91-96 | 89-96 | 105-117 | 109-137 |

[1]Residue numbering follows the nomenclature of Kabat et al., supra
[2]Residue numbering follows the nomenclature of Chothia et al., supra
[3]Residue numbering follows the nomenclature of MacCallum et al., supra
[4]Residue numbering follows the nomenclature of Lefranc et al., supra
[5]Residue numbering follows the nomenclature of Honegger and Plückthun, supra Cluster of Differentiation 22 or CD22: As used herein, refers to any native CD22 from any vertebrate source, including mammals such as primates (e.g., humans, cynomolgus monkey (cyno)) and rodents (e.g., mice and rats), unless otherwise indicated. The term encompasses "full-length," unprocessed CD22 as well as any form of CD22 that results from processing in the cell. The term also encompasses naturally occurring variants of CD22, e.g., splice variants, allelic variants, and isoforms. The major isoform of CD22 (CD22 beta) comprises 847 amino acids and seven immunoglobulin-like regions in the extracellular domain (see Wilson, G. L. et al., *J. Exp. Med.* 173: 137-146 (1991)). A minor isoform, CD22 alpha, comprises 647 amino acids and lacks immunoglobulin-like domains 3 and 4 in the extracellular domain (see Stamenkovic, I. and Seed, B., *Nature* 345: 74-77 (1990)) and Wilson et al. (1991), supra). In some embodiments, the anti-CD22 constructs described herein bind to an extracellular region of CD22 or a portion thereof (e.g., SEQ ID NO: 205 or a portion thereof).

Disease characterized by CD22 overexpression: As used herein, refers to a disease or disorder characterized or caused by cells overexpressing CD22 on the cell surface. In some embodiments, a disease or disorder characterized by CD22 overexpression is a CD22$^+$ B-cell malignancy.

CD22$^+$ B-cell malignancy: As used herein, refers to a disease or disorder characterized or caused by B-cells over-expressing CD22 on the cell surface. In some embodiments, a CD22$^+$ B-cell malignancy is a B-cell lymphoma or a B-cell leukemia.

Chimeric antigen receptors (CARs): Constructs of the present invention, including single chain variable fragments (scFv), may be used for the preparation of chimeric antigen receptors, the preparation and use of which is generally known in the art. A chimeric antigen receptor (CAR) is an artificially constructed hybrid single-chain protein or single-chain polypeptide containing a single-chain variable fragment (scFv) as a part of the extracellular antigen-binding domain, linked to a transmembrane domain (e.g., a TCR transmembrane domain), which is in turn linked to an intracellular immune cell (e.g., T cell or NK cell) signaling domain (e.g., a co-stimulatory domain; e.g., a portion of the intracellular domain of CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, a ligand that specifically binds with CD83, or the like; a portion of the intracellular domain of TCRζ, FcRγ, FcRβ, CD3γ, CD3δ, CD3ε, CD5, CD22, CD79a, CD79b, or CD66d; a portion of the intracellular domain of CD3ζ). Characteristics of CARs include their ability to redirect immune cell (e.g., T cell or NK cell) specificity and reactivity toward a selected target in either MHC-restricted (in case of TCR-mimic antibodies) or non-MHC-restricted (in case of antibodies against cell surface proteins) manners, exploiting the antigen-binding properties of monoclonal antibodies. The non-MHC-restricted antigen recognition gives immune cells (e.g., T cells or NK cells) expressing CARs the ability to recognize antigen independent of antigen processing, thus bypassing a major mechanism of tumor escape.

There are currently three generations of CARs. The "first generation" CARs are typically single-chain polypeptides composed of a scFv as the antigen-binding domain fused to a transmembrane domain fused to cytoplasmic/intracellular domain of the T cell receptor (TCR) chain. The "first generation" CARs typically have the intracellular domain from the CD3ζ chain, which is the primary transmitter of signals from endogenous TCRs. The "first generation" CARs can provide de novo antigen recognition and cause activation of both CD4$^+$ and CD8$^+$ T cells through their CD3ζ chain signaling domain in a single fusion molecule, independent of HLA-mediated antigen presentation.

The "second generation" CARs add intracellular domains from various co-stimulatory molecules (e.g., CD28, 4-1BB, ICOS, OX40) to the cytoplasmic tail of the CAR to provide additional signals to the T cell. "Second generation" CARs comprise those that provide both co-stimulation (e.g., CD28 or 4-IBB) and activation (e.g., CD3). Preclinical studies have indicated that the "second generation" CARs can improve the antitumor activity of T cells. For example, robust efficacy of the "second generation" CAR modified T cells was demonstrated in clinical trials targeting the CD19 molecule in patients with chronic lymphoblastic leukemia (CLL) and acute lymphoblastic leukemia (ALL).

In some embodiments, the engineered immune cells provided herein express a "third generation" CAR. The "third generation" CARs comprise those that provide multiple co-stimulation (e.g., CD28 and 4-1BB) and activation (e.g., CD3ζ).

Chimeric antibody-T cell receptor construct or caTCR: As used herein, this term refers to a functional polypeptide complex comprising two separate polypeptide chains, one including an antibody heavy chain variable region ($V_H$) and an antibody heavy chain constant region ($C_H$), and the other including an antibody light chain variable region ($V_L$) and an antibody light chain constant region ($C_L$). A caTCR as defined herein is therefore a 2-subunit construct, each subunit substantially resembling a cell membrane-anchored antibody heavy chain or light chain that is fused to a transmembrane domain (e.g., a TCR transmembrane domain) and an intracelluar immune cell signaling domain. In some embodiments, a caTCR does not include a co-stimulatory domain (e.g., a portion of the intracellular domain of CD3γ, CD3δ, CD3ε, or CD3ζ). In some embodiments, a caTCR comprises a) an extracellular domain comprising an antibody moiety and b) a T cell receptor module (TCRM) capable of recruiting at least one TCR-associated signaling module. In some embodiments, an anti-CD22 caTCR comprises a) an extracellular domain comprising an anti-CD22 antibody moiety that specifically binds to an extracellular region of CD22 or a portion thereof (e.g., SEQ ID NO: 205 or a portion thereof) and b) a T cell receptor module (TCRM) capable of recruiting at least one TCR-associated signaling module.

A caTCR as defined herein comprises a first polypeptide chain and a second polypeptide chain, in which the first polypeptide chain comprises an antibody $V_H$ fused to an antibody $C_H$ fused to a transmembrane domain and an intracelluar immune cell signaling domain, and the second polypeptide comprises an antibody $V_L$ fused to an antibody $C_L$ fused to a transmembrane domain and an intracelluar immune cell signaling domain. In some embodiments, the first and second polypeptide chains are linked, such as by a covalent linkage (e.g., peptide or other chemical linkage) or non-covalent linkage. In some embodiments, the anti-CD22 caTCR is a heterodimer comprising the first polypeptide chain and the second polypeptide chain. In some embodiments, the first polypeptide chain and the second polypeptide chain are linked by at least one disulfide bond. The specificity of the anti-CD22 caTCR derives from an antibody moiety that confers binding specificity to an extracellular region of CD22 or a portion thereof (e.g., SEQ ID NO: 205 or a portion thereof).

The terms "chimeric antibody-T cell receptor (caTCR)" and "antibody-TCR chimeric molecule or construct (abTCR)" are used interchangeably. Further descriptions and examples of caTCR may be found in, e.g., U.S. Application No. 62/490,576, filed Apr. 26, 2017, which is incorporated by reference herein in its entirety.

Adoptive cell therapy: Adoptive cell therapy is a therapeutic approach that typically includes isolation and ex vivo expansion and/or manipulation of immune cells (e.g., NK cells or T cells) and subsequent administration of these cells to a patient, for example for the treatment of cancer. Administered cells may be autologous or allogeneic. Cells may be manipulated to express engineered receptors (including CAR, caTCR, and engineered TCR) in any one of the known ways, including, for example, by using RNA and DNA transfection, viral transduction, electroporation, all of which are technologies known in the art.

The term "adoptive cell therapeutic composition" refers to any composition comprising cells suitable for adoptive cell transfer. In exemplary embodiments, the adoptive cell therapeutic composition comprises a cell type selected from a group consisting of a tumor infiltrating lymphocyte (TIL), TCR (i.e., heterologous T-cell receptor) modified lymphocytes (e.g., eTCR T cells and caTCR T cells) and CAR (i.e., chimeric antigen receptor) modified lymphocytes (e.g., CAR T cells). In another embodiment, the adoptive cell therapeutic composition comprises a cell type selected from a group consisting of T-cells, $CD8^+$ cells, $CD4^+$ cells, NK-cells, delta-gamma T-cells, regulatory T-cells, and peripheral blood mononuclear cells. In another embodiment, TILs, T-cells, $CD8^+$ cells, $CD4^+$ cells, NK-cells, delta-gamma T-cells, regulatory T-cells, or peripheral blood mononuclear cells form the adoptive cell therapeutic composition. In one embodiment, the adoptive cell therapeutic composition comprises T cells.

In some embodiments, the anti-CD22 construct expressed in the cell is a CAR (e.g, a "first generation," "second generation," or "third generation" CAR," as described above). In accordance with the presently disclosed subject matter, the CARs of the engineered immune cells provided herein comprise an extracellular antigen-binding domain, a transmembrane domain, and an intracellular domain.

In some embodiments, the anti-CD22 construct is a caTCR. As defined above, a caTCR is a 2-subunit construct, each subunit substantially resembling a cell membrane-anchored antibody heavy chain or light chain that is fused to a transmembrane domain (e.g., a TCR transmembrane domain). In some embodiments, a caTCR does not include a immune cell signaling domain (e.g., a co-stimulatory domain). In some embodiments, the caTCR does not in itself comprise a TCR-associated signaling molecule (such as CD3δε, CD3γε, and/or CD3ζ), at least not a functional one or a functional fragment of one. In some embodiments, the caTCR comprises an antigen-binding module (i.e., extracellular antigen binding domain) that provides the antigen specificity and a T cell receptor module (TCRM) that allows for CD3 recruitment and signaling. The antigen-binding module (i.e., extracellular antigen binding domain) is not a naturally occurring T cell receptor antigen-binding moiety. In some embodiments, the antigen-binding module (i.e., extracellular antigen binding domain) is linked to the amino terminus of a polypeptide chain in the TCRM. In some embodiments, the antigen-binding module (i.e., extracellular antigen binding domain) is an antibody moiety. In some embodiments, the antibody moiety is a Fab, a Fab', a (Fab')2, an Fv, or a single chain Fv (scFv). The TCRM comprises a transmembrane module derived from the transmembrane domains of one or more TCRs (TCR-TMs), such as an αβ and/or γδ TCR, and optionally further comprises one or both of the connecting peptides or fragments thereof of a TCR and/or one or more TCR intracellular domains or fragments thereof. In some embodiments, the TCRM comprises two polypeptide chains, each polypeptide chain comprising, from amino terminus to carboxy terminus, a connecting peptide, a transmembrane domain, and optionally a TCR intracellular domain. In some embodiments, the TCRM comprises one or more non-naturally occurring TCR domains. For example, in some embodiments, the TCRM comprises one or two non-naturally occurring TCR transmembrane domains. A non-naturally occurring TCR domain can be a corresponding domain of a naturally occurring TCR modified by substitution of one or more amino acids, and/or by replacement of a portion of the corresponding domain with a portion of an analogous domain from another TCR. The caTCR can comprise a first polypeptide chain and a second polypeptide chain, wherein the first and second polypeptide chains together form the antigen-binding module and the TCRM. In some embodiments, the first and second polypeptide chains are separate polypeptide chains, and the caTCR is a multimer, such as a dimer. In some embodiments, the first and second polypeptide chains are covalently linked, such as by a peptide linkage, or by another chemical linkage, such as a disulfide linkage. In some embodiments, the first polypeptide chain and the second polypeptide chain are linked by at least one disulfide bond. In some embodiments, the caTCR further comprises one or more T cell co-stimulatory signaling sequences. Examples of caTCRs are described in, for example, International Publication No. WO2017/070608 and U.S. Provisional Application No. 62/490,576, filed Apr. 26, 2017, both of which are incorporated by reference in their entireties.

Comparable: As used herein, refers to two or more agents, entities, situations, sets of conditions, etc. that may not be identical to one another but that are sufficiently similar to permit comparison there between so that conclusions may reasonably be drawn based on differences or similarities observed. In some embodiments, comparable sets of conditions, circumstances, individuals, or populations are characterized by a plurality of substantially identical features and one or a small number of varied features. Those of ordinary skill in the art will understand, in context, what degree of identity is required in any given circumstance for two or more such agents, entities, situations, sets of conditions, etc. to be considered comparable. For example, those of ordinary skill in the art will appreciate that sets of circumstances, individuals, or populations are comparable to one another when characterized by a sufficient number and type of substantially identical features to warrant a reasonable conclusion that differences in results obtained or phenomena observed under or with different sets of circumstances, individuals, or populations are caused by or indicative of the variation in those features that are varied.

Control: As used herein, refers to the art-understood meaning of a "control" being a standard against which results are compared. Typically, controls are used to augment integrity in experiments by isolating variables in order to make a conclusion about such variables. In some embodiments, a control is a reaction or assay that is performed simultaneously with a test reaction or assay to provide a comparator. As used herein, a "control" may refer to a "control antibody". A "control antibody" may be a human, chimeric, humanized, CDR-grafted, multispecific, or bispecific antibody as described herein, an antibody that is different as described herein, or a parental antibody. In one experiment, the "test" (i.e., the variable being tested) is applied. In the second experiment, the "control," the variable being tested is not applied. In some embodiments, a control is a historical control (i.e., of a test or assay performed previously, or an amount or result that is previously known). In some embodiments, a control is or comprises a printed or otherwise saved record. A control may be a positive control or a negative control.

Corresponding to: As used herein designates the position/identity of an amino acid residue in a polypeptide of interest. Those of ordinary skill will appreciate that, for purposes of simplicity, residues in a polypeptide are often designated using a canonical numbering system based on a reference related polypeptide, so that an amino acid "corresponding to" a residue at position 190, for example, need not actually be the 190th amino acid in a particular amino acid chain but rather corresponds to the residue found at 190 in the reference polypeptide; those of ordinary skill in the art readily appreciate how to identify "corresponding" amino acids.

Detection entity/agent: As used herein, refers to any element, molecule, functional group, compound, fragment or moiety that is detectable. In some embodiments, a detection entity is provided or utilized alone. In some embodiments, a detection entity is provided and/or utilized in association with (e.g., joined to) another agent. Examples of detection entities include, but are not limited to: various ligands, radionuclides (e.g., 3H, 14C, 18F, 19F, 32P, 35S, 135I, 125I, 123I, 64Cu, 187Re, 111In, 90Y, 99mTc, 177Lu, 89Zr etc.), fluorescent dyes (for specific exemplary fluorescent dyes, see below), chemiluminescent agents (such as, for example, acridinum esters, stabilized dioxetanes, and the like), bioluminescent agents, spectrally resolvable inorganic fluorescent semiconductors nanocrystals (i.e., quantum dots), metal nanoparticles (e.g., gold, silver, copper, platinum, etc.) nanoclusters, paramagnetic metal ions, enzymes (for specific examples of enzymes, see below), colorimetric labels (such as, for example, dyes, colloidal gold, and the like), biotin, dioxigenin, haptens, and proteins for which antisera or monoclonal antibodies are available.

Effector function: As used herein refers a biochemical event that results from the interaction of an antibody Fc region with an Fc receptor or ligand. Effector functions include but are not limited to antibody-dependent cell-mediated cytotoxicity (ADCC), antibody-dependent cell-mediated phagocytosis (ADCP), and complement-mediated cytotoxicity (CMC). In some embodiments, an effector function is one that operates after the binding of an antigen, one that operates independent of antigen binding, or both.

Effector cell: As used herein refers to a cell of the immune system that mediates one or more effector functions. In some embodiments, effector cells may include, but may not be limited to, one or more of monocytes, macrophages, neutrophils, dendritic cells, eosinophils, mast cells, platelets, large granular lymphocytes, Langerhans' cells, natural killer (NK) cells, T-lymphocytes, B-lymphocytes and may be from any organism including but not limited to humans, mice, rats, rabbits, and monkeys.

Engineered: As used herein refers, in general, to the aspect of having been manipulated by the hand of man. For example, in some embodiments, a polynucleotide may be considered to be "engineered" when two or more sequences that are not linked together in that order in nature are manipulated by the hand of man to be directly linked to one another in the engineered polynucleotide. In some particular such embodiments, an engineered polynucleotide may comprise a regulatory sequence that is found in nature in operative association with a first coding sequence but not in operative association with a second coding sequence, is linked by the hand of man so that it is operatively associated with the second coding sequence. Alternatively or additionally, in some embodiments, first and second nucleic acid sequences that each encode polypeptide elements or domains that in nature are not linked to one another may be linked to one another in a single engineered polynucleotide. Comparably, in some embodiments, a cell or organism may be considered to be "engineered" if it has been manipulated so that its genetic information is altered (e.g., new genetic material not previously present has been introduced, or previously present genetic material has been altered or removed). As is common practice and is understood by those in the art, progeny of an engineered polynucleotide or cell are typically still referred to as "engineered" even though the actual manipulation was performed on a prior entity. Furthermore, as will be appreciated by those skilled in the art, a variety of methodologies are available through which "engineering" as described herein may be achieved. For example, in some embodiments, "engineering" may involve selection or design (e.g., of nucleic acid sequences, polypeptide sequences, cells, tissues, and/or organisms) through use of computer systems programmed to perform analysis or comparison, or otherwise to analyze, recommend, and/or select sequences, alterations, etc.). Alternatively or additionally, in some embodiments, "engineering" may involve use of in vitro chemical synthesis methodologies and/or recombinant nucleic acid technologies such as, for example, nucleic acid amplification (e.g., via the polymerase chain reaction) hybridization, mutation, transformation, transfection, etc., and/or any of a variety of controlled mating methodologies. As will be appreciated by those skilled in the art, a variety of established such techniques (e.g., for recombinant DNA, oligonucleotide synthesis, and tissue culture and transformation (e.g., electroporation, lipofection, etc.) are well known in the art and described in various general and more specific references that are cited and/or discussed throughout the present specification. See e.g., Sambrook et al., *Molecular Cloning: A Laboratory Manual* (2d ed., Cold Spring Harbor Laboratory Press, Cold Spring Harbor, N.Y., 1989).

Epitope: As used herein, includes any moiety that is specifically recognized by an immunoglobulin (e.g., antibody or receptor) binding component. In some embodiments, an epitope is comprised of a plurality of chemical atoms or groups on an antigen. In some embodiments, such chemical atoms or groups are surface-exposed when the antigen adopts a relevant three-dimensional conformation. In some embodiments, such chemical atoms or groups are physically near to each other in space when the antigen adopts such a conformation. In some embodiments, at least some such chemical atoms are groups are physically separated from one another when the antigen adopts an alternative conformation (e.g., is linearized). In some embodiments of the present invention, an anti-CD22 construct described herein binds to an epitope comprising at least 7 amino acids of the sequence of SEQ ID NO: 205 (e.g., at least 7 contiguous amino acids of the sequence of SEQ ID NO: 205). An anti-CD22 construct described herein may bind to an epitope comprising between 7 and 50 amino acids (e.g., between 7 and 50 contiguous amino acids) of the sequence of SEQ ID NO: 205, e.g., between 7 and 45, between 7 and between 7 and 40, between 7 and 35, between 7 and 30, between 7 and 25, between 7 and 20, between 7 and 15, between 7 and 10, between 10 and 50, between 15 and 50, between 20 and 50, between 25 and 50, between 30 and 50, between 35 and 50, between 40 and 50, between 45 and 50, between 10 and 45, between 15 and 40, between 20 and 35, or between 25 and 30 amino acids of the sequence of SEQ ID NO: 205.

Excipient: As used herein, refers to a non-therapeutic agent that may be included in a pharmaceutical composition, for example to provide or contribute to a desired consistency or stabilizing effect. Suitable pharmaceutical excipients include, for example, starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like.

Expression cassette: As used herein, refers to a nucleic acid construct that, when introduced into a host cell, results in transcription and/or translation of an RNA or polypeptide, respectively.

Heterologous: As used herein, refers to a polynucleotide or polypeptide that does not naturally occur in a host cell or a host organism. A heterologous polynucleotide or polypeptide may be introduced into the host cell or host organism using well-known recombinant methods, e.g., using an expression cassette comprising the heterologous polynucleotide optionally linked to a promoter.

Framework or framework region: As used herein, refers to the sequences of a variable region minus the CDRs. Because a CDR sequence can be determined by different systems, likewise a framework sequence is subject to correspondingly different interpretations. The six CDRs divide the framework regions on the heavy and light chains into four sub-regions (FR1, FR2, FR3 and FR4) on each chain, in which CDR1 is positioned between FR1 and FR2, CDR2 between FR2 and FR3, and CDR3 between FR3 and FR4. Without specifying the particular sub-regions as FR1, FR2, FR3 or FR4, a framework region, as referred by others, represents the combined FRs within the variable region of a single, naturally occurring immunoglobulin chain. As used herein, a FR represents one of the four sub-regions, FR1, for example, represents the first framework region closest to the amino terminal end of the variable region and 5' with respect to CDR1, and FRs represents two or more of the sub-regions constituting a framework region.

Host cell: As used herein, refers to a cell into which exogenous DNA (recombinant or otherwise) has been introduced. Persons of skill upon reading this disclosure will understand that such terms refer not only to the particular subject cell, but also to the progeny of such a cell. Because certain modifications may occur in succeeding generations due to either mutation or environmental influences, such progeny may not, in fact, be identical to the parent cell, but are still included within the scope of the term "host cell" as used herein. In some embodiments, host cells include prokaryotic and eukaryotic cells selected from any of the Kingdoms of life that are suitable for expressing an exogenous DNA (e.g., a recombinant nucleic acid sequence). Exemplary cells include those of prokaryotes and eukaryotes (single-cell or multiple-cell), bacterial cells (e.g., strains of *E. coli, Bacillus* spp., *Streptomyces* spp., etc.), mycobacteria cells, fungal cells, yeast cells (e.g., *S. cerevisiae, S. pombe, P. pastoris, P. methanolica*, etc.), plant cells, insect cells (e.g., SF-9, SF-21, baculovirus-infected insect cells, *Trichoplusia ni*, etc.), non-human animal cells, human cells, or cell fusions such as, for example, hybridomas or quadromas. In some embodiments, a host cell is a human, monkey, ape, hamster, rat, or mouse cell. In some embodiments, a host cell is eukaryotic and is selected from the following cells: CHO (e.g., CHO K1, DXB-1 1 CHO, Veggie-CHO), COS (e.g., COS-7), retinal cell, Vero, CV1, kidney (e.g., HEK293, 293 EBNA, MSR 293, MDCK, HaK, BHK), HeLa, HepG2, WI38, MRC 5, Colo205, HB 8065, HL-60, (e.g., BHK21), Jurkat, Daudi, A431 (epidermal), CV-1, U937, 3T3, L cell, C127 cell, SP2/0, NS-0, MMT 060562, Sertoli cell, BRL 3 A cell, HT1080 cell, myeloma cell, tumor cell, and a cell line derived from an aforementioned cell. In some embodiments, a host cell comprises one or more viral genes, e.g., a retinal cell that expresses a viral gene (e.g., a PER.C6™ cell).

Human antibody: As used herein, is intended to include antibodies having variable and constant regions generated (or assembled) from human immunoglobulin sequences. In some embodiments, antibodies (or antibody moieties) may be considered to be "human" even though their amino acid sequences include residues or elements not encoded by human germline immunoglobulin sequences (e.g., include sequence variations, for example, that may (originally) have been introduced by random or site-specific mutagenesis in vitro or by somatic mutation in vivo), for example in one or more CDRs and in particular CDR3. Human antibodies, human antibody moieties, and their fragments can be isolated from human immune cells or generated recombinantly or synthetically, including semi-synthetically.

Humanized: As is known in the art, the term "humanized" is commonly used to refer to antibodies (or moieties) whose amino acid sequence includes $V_H$ and $V_L$ region sequences from a reference antibody raised in a non-human species (e.g., a mouse), but also includes modifications in those sequences relative to the reference antibody intended to render them more "human-like", i.e., more similar to human germline variable sequences. In some embodiments, a "humanized" antibody (or antibody moiety) is one that immunospecifically binds to an antigen of interest and that has a framework (FR) region having substantially the amino acid sequence as that of a human antibody, and a complementary determining region (CDR) having substantially the amino acid sequence as that of a non-human antibody. A humanized antibody comprises substantially all of at least one, and typically two, variable domains (Fab, Fab', F(ab')$_2$, FabC, Fv) in which all or substantially all of the CDR regions correspond to those of a non-human immunoglobulin (i.e., donor immunoglobulin) and all or substantially all of the framework regions are those of a human immunoglobulin consensus sequence. In some embodiments, a humanized antibody also comprises at least a portion of an immunoglobulin constant region (Fc), typically that of a human immunoglobulin constant region. In some embodiments, a humanized antibody contains both the light chain as well as at least the variable domain of a heavy chain. The antibody also may include a $C_H1$, hinge, $C_H2$, $C_H3$, and, optionally, a $C_H4$ region of a heavy chain constant region. In some embodiments, a humanized antibody only contains a humanized $V_L$ region. In some embodiments, a humanized antibody only contains a humanized $V_H$ region. In some certain embodiments, a humanized antibody contains humanized $V_H$ and $V_L$ regions.

Hydrophilic: As used herein, the term "hydrophilic" and/or "polar" refers to a tendency to mix with, or dissolve easily in, water.

Hydrophobic: As used herein, the term "hydrophobic" and/or "non-polar", refers to a tendency to repel, not combine with, or an inability to dissolve easily in, water.

Improve, increase, or reduce: As used herein, or grammatical equivalents thereof, indicate values that are relative to a baseline measurement, such as a measurement in the same individual prior to initiation of a treatment described herein, or a measurement in a control individual (or multiple control individuals) in the absence of the treatment described herein. A "control individual" is an individual afflicted with the same form of disease or injury as the individual being treated. In some embodiments, the methods for treating a B-cell malignancy using an anti-CD22 construct described herein may increase cell apoptosis (e.g., increase $CD22^+$ tumor cell apoptosis) in an individual by at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, or at least 90% compared to the individual prior to receiving treatment or to a control individual. In some embodiments, the methods for treating a B-cell malignancy using an anti-CD22 construct described herein may reduce tumor size (e.g., reduce $CD22^+$ tumor size) in an individual by at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, or at least 90% compared to the individual prior to receiving treatment or to a control individual.

In vitro: As used herein refers to events that occur in an artificial environment, e.g., in a test tube or reaction vessel, in cell culture, etc., rather than within a multi-cellular organism.

In vivo: As used herein refers to events that occur within a multi-cellular organism, such as a human and a non-human animal. In the context of cell-based systems, the term may be used to refer to events that occur within a living cell (as opposed to, for example, in vitro systems).

Isolated: As used herein, refers to a substance and/or entity that has been (1) separated from at least some of the components with which it was associated when initially produced (whether in nature and/or in an experimental setting), and/or (2) designed, produced, prepared, and/or manufactured by the hand of man. Isolated substances and/or entities may be separated from about 10%, about 20%, about 30%, about 40%, about 50%, about 60%, about 70%, about 80%, about 90%, about 91%, about 92%, about 93%, about 94%, about 95%, about 96%, about 97%, about 98%, about 99%, or more than about 99% of the other components with which they were initially associated. In some embodiments, isolated agents are about 80%, about 85%, about 90%, about 91%, about 92%, about 93%, about 94%, about 95%, about 96%, about 97%, about 98%, about 99%, or more than about 99% pure. As used herein, a substance is "pure" if it is substantially free of other components. In some embodiments, as will be understood by those skilled in the art, a substance may still be considered "isolated" or even "pure", after having been combined with certain other components such as, for example, one or more carriers or excipients (e.g., buffer, solvent, water, etc.); in such embodiments, percent isolation or purity of the substance is calculated without including such carriers or excipients. To give but one example, in some embodiments, a biological polymer such as a polypeptide or polynucleotide that occurs in nature is considered to be "isolated" when, a) by virtue of its origin or source of derivation is not associated with some or all of the components that accompany it in its native state in nature; b) it is substantially free of other polypeptides or nucleic acids of the same species from the species that produces it in nature; c) is expressed by or is otherwise in association with components from a cell or other expression system that is not of the species that produces it in nature. Thus, for instance, in some embodiments, a polypeptide that is chemically synthesized or is synthesized in a cellular system different from that which produces it in nature is considered to be an "isolated" polypeptide. Alternatively or additionally, in some embodiments, a polypeptide that has been subjected to one or more purification techniques may be considered to be an "isolated" polypeptide to the extent that it has been separated from other components a) with which it is associated in nature; and/or b) with which it was associated when initially produced.

$K_D$: As used herein, refers to the dissociation constant of a binding agent (e.g., an antibody agent or binding component thereof) from a complex with its partner (e.g., the epitope to which the antibody agent or binding component thereof binds).

$k_{off}$: As used herein, refers to the off rate constant for dissociation of a binding agent (e.g., an antibody agent or binding component thereof) from a complex with its partner (e.g., the epitope to which the antibody agent or binding component thereof binds).

$k_{on}$: As used herein, refers to the on rate constant for association of a binding agent (e.g., an antibody agent or binding component thereof) with its partner (e.g., the epitope to which the antibody agent or binding component thereof binds).

Linker: As used herein, is used to refer to that portion of a multi-element polypeptide that connects different elements to one another. For example, those of ordinary skill in the art appreciate that a polypeptide whose structure includes two or more functional or organizational domains often includes a stretch of amino acids between such domains that links them to one another. In some embodiments, a polypeptide comprising a linker element has an overall structure of the general form S1-L-S2, wherein S1 and S2 may be the same or different and represent two domains associated with one another by the linker. In some embodiments, a linker is at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, 75, 80, 85, 90, 95, 100 or more amino acids in length. In some embodiments, a linker has between 3 and 7 amino acids, between 7 and 15 amino acids, or between 20 and 30 (e.g., between 20 and 25 or between 25 and 30) amino acids. In some embodiments, a linker is characterized in that it tends not to adopt a rigid three-dimensional structure, but rather provides flexibility to the polypeptide. A variety of different linker elements that can appropriately be used when engineering polypeptides (e.g., fusion polypeptides) known in the art (see e.g., Holliger, P., et al., 1993, *Proc. Natl. Acad. Sci. U.S.A.* 90: 6444-6448; Poljak, R. J. et al., 1994, *Structure* 2: 1121-1123).

Multivalent binding antibody (or multispecific antibody): As used herein, refers an antibody capable of binding to two or more antigens, which can be on the same molecule or on different molecules. Multivalent binding antibodies as described herein are, in some embodiments, engineered to have the two or more antigen binding sites, and are typically not naturally occurring proteins. Multivalent binding antibodies as described herein refer to antibodies capable of binding two or more related or unrelated targets. Multivalent binding antibodies may be composed of multiple copies of a single antibody moiety or multiple copies of different antibody moieties. Such antibodies are capable of binding to two or more antigens and may be tetravalent or multivalent. Multivalent binding antibodies may additionally comprise a therapeutic agent, such as, for example, an immunomodulator, toxin or an RNase. Multivalent binding antibodies as described herein are, in some embodiments, capable of binding simultaneously to at least two targets that are of different structure, e.g., two different antigens, two different epitopes on the same antigen, or a hapten and/or an antigen or epitope. Multivalent binding antibodies of the present invention may be monospecific (capable of binding one antigen) or multispecific (capable of binding two or more antigens), and may be composed of two heavy chain polypeptides and two light chain polypeptides. Each binding site, in some embodiments, is composed of a heavy chain variable domain and a light chain variable domain with a total of six CDRs involved in antigen binding per antigen binding site.

Nucleic acid: As used herein, in its broadest sense, refers to any compound and/or substance that is or can be incorporated into an oligonucleotide chain. In some embodiments, a nucleic acid is a compound and/or substance that is or can be incorporated into an oligonucleotide chain via a phosphodiester linkage. As will be clear from context, in some embodiments, "nucleic acid" refers to individual nucleic acid residues (e.g., nucleotides and/or nucleosides); in some embodiments, "nucleic acid" refers to an oligonucleotide chain comprising individual nucleic acid residues. In some embodiments, a "nucleic acid" is or comprises RNA; in some embodiments, a "nucleic acid" is or comprises DNA. In some embodiments, a nucleic acid is, comprises, or consists of one or more natural nucleic acid residues. In some embodiments, a nucleic acid is, comprises, or consists of one or more nucleic acid analogs. In some embodiments, a nucleic acid analog differs from a nucleic acid in that it does not utilize a phosphodiester backbone. For example, in some embodiments, a nucleic acid is, comprises, or consists of one or more "peptide nucleic acids", which are known in the art and have peptide bonds instead of phosphodiester bonds in the backbone, are considered within the scope of the present invention. Alternatively or additionally, in some embodiments, a nucleic acid has one or more phosphorothioate and/or 5'-N-phosphoramidite linkages rather than phosphodiester bonds.

In some embodiments, a nucleic acid is, comprises, or consists of one or more natural nucleosides (e.g., adenosine, thymidine, guanosine, cytidine, uridine, deoxyadenosine, deoxythymidine, deoxy guanosine, and deoxycytidine). In some embodiments, a nucleic acid is, comprises, or consists of one or more nucleoside analogs (e.g., 2-aminoadenosine, 2-thiothymidine, inosine, pyrrolo-pyrimidine, 3-methyl adenosine, 5-methylcytidine, C-5 propynyl-cytidine, C-5 propynyl-uridine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, 0(6)-methylguanine, 2-thiocytidine, methylated bases, intercalated bases, and combinations thereof). In some embodiments, a nucleic acid comprises one or more modified sugars (e.g., 2'-fluororibose, ribose, 2'-deoxyribose, arabinose, and hexose) as compared with those in natural nucleic acids. In some embodiments, a nucleic acid has a nucleotide sequence that encodes a functional gene product such as an RNA or protein. In some embodiments, a nucleic acid includes one or more introns. In some embodiments, nucleic acids are prepared by one or more of isolation from a natural source, enzymatic synthesis by polymerization based on a complementary template (in vivo or in vitro), reproduction in a recombinant cell or system, and chemical synthesis. In some embodiments, a nucleic acid is at least 3, 4, 5, 6, 7, 8, 9, 10, 15, 20, 25, 30, 35, 40, 45, 50, 55, 60, 65, 70, 75, 80, 85, 90, 95, 100, 110, 120, 130, 140, 150, 160, 170, 180, 190, 20, 225, 250, 275, 300, 325, 350, 375, 400, 425, 450, 475, 500, 600, 700, 800, 900, 1000, 1500, 2000, 2500, 3000, 3500, 4000, 4500, 5000 or more residues long. In some embodiments, a nucleic acid is single stranded; in some embodiments, a nucleic acid is double stranded. In some embodiments a nucleic acid has a nucleotide sequence comprising at least one element that encodes, or is the complement of a sequence that encodes, a polypeptide. In some embodiments, a nucleic acid has enzymatic activity.

Operably linked: As used herein, refers to a juxtaposition wherein the components described are in a relationship permitting them to function in their intended manner. A control sequence "operably linked" to a coding sequence is ligated in such a way that expression of the coding sequence is achieved under conditions compatible with the control sequences. "Operably linked" sequences include both expression control sequences that are contiguous with a gene of interest and expression control sequences that act in trans or at a distance to control said gene of interest. The term "expression control sequence" as used herein refers to polynucleotide sequences that are necessary to effect the expression and processing of coding sequences to which they are ligated. Expression control sequences include appropriate transcription initiation, termination, promoter and enhancer sequences; efficient RNA processing signals such as splicing and polyadenylation signals; sequences that stabilize cytoplasmic mRNA; sequences that enhance translation efficiency (i.e., Kozak consensus sequence); sequences that enhance protein stability; and when desired, sequences that enhance protein secretion. The nature of such control sequences differs depending upon the host organism. For example, in prokaryotes, such control sequences generally include promoter, ribosomal binding site, and transcription termination sequence, while in eukaryotes, typically, such control sequences include promoters and transcription termination sequence. The term "control sequences" is intended to include components whose presence is essential for expression and processing, and can also include additional components whose presence is advantageous, for example, leader sequences and fusion partner sequences.

Physiological conditions: As used herein, has its art-understood meaning referencing conditions under which cells or organisms live and/or reproduce. In some embodiments, the term refers to conditions of the external or internal milieu that may occur in nature for an organism or cell system. In some embodiments, physiological conditions are those conditions present within the body of a human or non-human animal, especially those conditions present at and/or within a surgical site. Physiological conditions typically include, e.g., a temperature range of 20-40° C., atmospheric pressure of 1, pH of 6-8, glucose concentration of 1-20 mM, oxygen concentration at atmospheric levels, and gravity as it is encountered on earth. In some embodiments, conditions in a laboratory are manipulated and/or maintained at physiologic conditions. In some embodiments, physiological conditions are encountered in an organism.

Polypeptide: As used herein, refers to any polymeric chain of amino acids. In some embodiments, the amino acids are joined to each other by peptide bonds or modified peptide bonds. In some embodiments, a polypeptide has an amino acid sequence that occurs in nature. In some embodiments, a polypeptide has an amino acid sequence that does not occur in nature. In some embodiments, a polypeptide has an amino acid sequence that is engineered in that it is synthetically designed and/or produced. In some embodiments, a polypeptide may comprise or consist of natural amino acids, non-natural amino acids, or both. In some embodiments, a polypeptide may comprise or consist of only natural amino acids or only non-natural amino acids. In some embodiments, a polypeptide may comprise D-amino acids, L-amino acids, or both. In some embodiments, a polypeptide may comprise only D-amino acids. In some embodiments, a polypeptide may comprise only L-amino acids.

In some embodiments, a polypeptide may include one or more pendant groups or other modifications, e.g., modifying or attached to one or more amino acid side chains, at the polypeptide's N-terminus, at the polypeptide's C-terminus, or any combination thereof. In some embodiments, such pendant groups or modifications may be selected from the group consisting of acetylation, amidation, lipidation, methylation, pegylation, etc., including combinations thereof. In some embodiments, a polypeptide may be cyclic, and/or may comprise a cyclic portion. In some embodiments, a polypeptide is not cyclic and/or does not comprise any cyclic portion. In some embodiments, a polypeptide is linear. In some embodiments, a polypeptide may be or comprise a stapled polypeptide. In some embodiments, the term "polypeptide" may be appended to a name of a reference polypeptide, activity, or structure; in such instances it is used herein to refer to polypeptides that share the relevant activity or structure and thus can be considered to be members of the same class or family of polypeptides. For each such class, the present specification provides and/or those skilled in the art will be aware of exemplary polypeptides within the class whose amino acid sequences and/or functions are known; in some embodiments, such exemplary polypeptides are reference polypeptides for the polypeptide class.

In some embodiments, a member of a polypeptide class or family shows significant sequence homology or identity with, shares a common sequence motif (e.g., a characteristic sequence element) with, and/or shares a common activity (in some embodiments at a comparable level or within a designated range) with a reference polypeptide of the class; in some embodiments with all polypeptides within the class). For example, in some embodiments, a member polypeptide shows an overall degree of sequence homology or identity with a reference polypeptide that is at least about 30 to 40%, and is often greater than about 50%, 60%, 70%, 80%, 90%, 91%, 92%, 93%, 94%, 95%, 96%, 97%, 98%, 99% or more and/or includes at least one region (i.e., a conserved region that may in some embodiments may be or comprise a characteristic sequence element) that shows very high sequence identity, often greater than 90% or even 95%, 96%, 97%, 98%, or 99%. Such a conserved region usually encompasses at least three to four and often up to 20 or more amino acids; in some embodiments, a conserved region encompasses at least one stretch of at least 2, 3, 4, 5, 6, 7, 8, 9, 10, 11, 12, 13, 14, 15 or more contiguous amino acids. In some embodiments, a useful polypeptide may comprise or consist of a fragment of a parent polypeptide. In some embodiments, a useful polypeptide as may comprise or consist of a plurality of fragments, each of which is found in the same parent polypeptide in a different spatial arrangement relative to one another than is found in the polypeptide of interest (e.g., fragments that are directly linked in the parent may be spatially separated in the polypeptide of interest or vice-versa, and/or fragments may be present in a different order in the polypeptide of interest than in the parent), so that the polypeptide of interest is a derivative of its parent polypeptide.

Prevent or prevention: As used herein when used in connection with the occurrence of a disease, disorder, and/or condition, refers to reducing the risk of developing the disease, disorder and/or condition and/or to delaying onset of one or more characteristics or symptoms of the disease, disorder or condition. Prevention may be considered complete when onset of a disease, disorder or condition has been delayed for a predefined period of time.

Recombinant: As used herein, is intended to refer to polypeptides (e.g., antibodies or antibody moieties) that are designed, engineered, prepared, expressed, created or isolated by recombinant means, such as polypeptides expressed using a recombinant expression vector transfected into a host cell, polypeptides isolated from a recombinant, combinatorial human polypeptide library (Hoogenboom H. R., 1997, TIB Tech. 15: 62-70; Azzazy H., and Highsmith W. E., 2002, Clin. Biochem. 35: 425-45; Gavilondo J. V., and Larrick J. W., 2002, BioTechniques 29: 128-45; Hoogenboom H., and Chames P., 2000, Immunol. Today 21: 371-8), antibodies isolated from an animal (e.g., a mouse) that is transgenic for human immunoglobulin genes (see e.g., Taylor, L. D., et al., 1992, Nucl. Acids Res. 20: 6287-95; Kellermann S-A., and Green L. L., 2002, Curr. Opin. Biotech. 13: 593-7; Little, M. et al., 2000, Immunol. Today 21: 364-70; Murphy, A. J. et al., 2014, Proc. Natl. Acad. Sci. U.S.A. 111(14): 5153-8) or polypeptides prepared, expressed, created or isolated by any other means that involves splicing selected sequence elements to one another. In some embodiments, one or more of such selected sequence elements is found in nature. In some embodiments, one or more of such selected sequence elements is designed in silico. In some embodiments, one or more such selected sequence elements results from mutagenesis (e.g., in vivo or in vitro) of a known sequence element, e.g., from a natural or synthetic source. For example, in some embodiments, a recombinant antibody is comprised of sequences found in the germline of a source organism of interest (e.g., human, mouse, etc.). In some embodiments, a recombinant antibody has an amino acid sequence that resulted from mutagenesis (e.g., in vitro or in vivo, for example in a transgenic animal), so that the amino acid sequences of the $V_H$ and $V_L$ regions of the recombinant antibodies are sequences that, while originating from and related to germline $V_H$ and $V_L$ sequences, may not naturally exist within the germline antibody repertoire in vivo.

Reference: As used herein describes a standard, control, or other appropriate reference against which a comparison is made as described herein. For example, in some embodiments, a reference is a standard or control agent, animal, individual, population, sample, sequence, series of steps, set of conditions, or value against which an agent, animal, individual, population, sample, sequence, series of steps, set of conditions, or value of interest is compared. In some embodiments, a reference is tested and/or determined substantially simultaneously with the testing or determination of interest. In some embodiments, a reference is a historical reference, optionally embodied in a tangible medium. Typically, as would be understood by those skilled in the art, a reference is determined or characterized under conditions comparable to those utilized in the assessment of interest.

Specific binding: As used herein, refers to a binding agent's ability to discriminate between possible partners in the environment in which binding is to occur. A binding agent that interacts with one particular target when other potential targets are present is said to "bind specifically" to the target with which it interacts. In some embodiments, specific binding is assessed by detecting or determining degree of association between the binding agent and its partner; in some embodiments, specific binding is assessed by detecting or determining degree of dissociation of a binding agent-partner complex; in some embodiments, specific binding is assessed by detecting or determining ability of the binding agent to compete an alternative interaction between its partner and another entity. In some embodiments, specific binding is assessed by performing such detections or determinations across a range of concentrations. In some embodiments, specific binding is assessed by determining the difference in binding affinity between cognate and non-cognate targets. For example, a binding agent may have a binding affinity for a cognate target that is about 3-fold, 4-fold, 5-fold, 6-fold, 7-fold, 8-fold, 9-fold, 10-fold or more than binding affinity for a non-cognate target.

Specificity: As is known in the art, "specificity" is a measure of the ability of a particular ligand to distinguish its binding partner from other potential binding partners.

Subject: As used herein, means any mammal, including humans. In certain embodiments of the present invention the subject is an adult, an adolescent or an infant. In some embodiments, terms "individual" or "patient" are used and are intended to be interchangeable with "subject." Also contemplated by the present invention are the administration of the pharmaceutical compositions and/or performance of the methods of treatment in utero.

Substantially: As used herein, the term "substantially" refers to the qualitative condition of exhibiting total or near-total extent or degree of a characteristic or property of interest. One of ordinary skill in the biological arts will understand that biological and chemical phenomena rarely, if ever, go to completion and/or proceed to completeness or achieve or avoid an absolute result. The term "substantially" is therefore used herein to capture the potential lack of completeness inherent in many biological and chemical phenomena.

Substantial sequence homology: As used herein, the phrase "substantial homology" to refers to a comparison between amino acid or nucleic acid sequences. As will be appreciated by those of ordinary skill in the art, two sequences are generally considered to be "substantially homologous" if they contain homologous residues in corresponding positions. Homologous residues may be identical residues. Alternatively, homologous residues may be non-identical residues with appropriately similar structural and/or functional characteristics. For example, as is well known by those of ordinary skill in the art, certain amino acids are typically classified as "hydrophobic" or "hydrophilic" amino acids, and/or as having "polar" or "non-polar" side chains. Substitution of one amino acid for another of the same type may often be considered a "homologous" substitution. Typical amino acid categorizations are summarized as follows:

| Alanine | Ala | A | Nonpolar | Neutral | 1.8 |
|---|---|---|---|---|---|
| Arginine | Arg | R | Polar | Positive | −4.5 |
| Asparagine | Asn | N | Polar | Neutral | −3.5 |
| Aspartic acid | Asp | D | Polar | Negative | −3.5 |
| Cysteine | Cys | C | Nonpolar | Neutral | 2.5 |
| Glutamic acid | Glu | E | Polar | Negative | −3.5 |
| Glutamine | Gln | Q | Polar | Neutral | −3.5 |
| Glycine | Gly | G | Nonpolar | Neutral | −0.4 |
| Histidine | His | H | Polar | Positive | −3.2 |
| Isoleucine | Ile | I | Nonpolar | Neutral | 4.5 |
| Leucine | Leu | L | Nonpolar | Neutral | 3.8 |
| Lysine | Lys | K | Polar | Positive | −3.9 |
| Methionine | Met | M | Nonpolar | Neutral | 1.9 |
| Phenylalanine | Phe | F | Nonpolar | Neutral | 2.8 |
| Proline | Pro | P | Nonpolar | Neutral | −1.6 |
| Serine | Ser | S | Polar | Neutral | −0.8 |
| Threonine | Thr | T | Polar | Neutral | −0.7 |
| Tryptophan | Trp | W | Nonpolar | Neutral | −0.9 |
| Tyrosine | Tyr | Y | Polar | Neutral | −1.3 |
| Valine | Val | V | Nonpolar | Neutral | 4.2 |

| Ambiguous Amino Acids | 3-Letter | 1-Letter |
|---|---|---|
| Asparagine or aspartic acid | Asx | B |
| Glutamine or glutamic acid | Glx | Z |
| Leucine or Isoleucine | Xle | J |
| Unspecified or unknown amino acid | Xaa | X |

As is well known in this art, amino acid or nucleic acid sequences may be compared using any of a variety of algorithms, including those available in commercial computer programs such as BLASTN for nucleotide sequences and BLASTP, gapped BLAST, and PSI-BLAST for amino acid sequences. Exemplary such programs are described in Altschul et al., 1990, *J. Mol. Biol.,* 215(3): 403-410; Altschul et al., 1996, *Meth. Enzymology* 266: 460-480; Altschul et al., 1997, *Nucleic Acids Res.* 25: 3389-3402; Baxevanis et al, *Bioinformatics: A Practical Guide to the Analysis of Genes and Proteins*, Wiley, 1998; and Misener, et al, (eds.), Bioinformatics Methods and Protocols (Methods in Molecular Biology, Vol. 132), Humana Press, 1999. In addition to identifying homologous sequences, the programs mentioned above typically provide an indication of the degree of homology. In some embodiments, two sequences are considered to be substantially homologous if at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or more of their corresponding residues are homologous over a relevant stretch of residues. In some embodiments, the relevant stretch is a complete sequence. In some embodiments, the relevant stretch is at least 10, at least 15, at least 20, at least 25, at least 30, at least 35, at least 40, at least 45, at least 50, at least 55, at least 60, at least 65, at least 70, at least 75, at least 80, at least 85, at least 90, at least 95, at least 100, at least 125, at least 150, at least 175, at least 200, at least 225, at least 250, at least 275, at least 300, at least 325, at least 350, at least 375, at least 400, at least 425, at least 450, at least 475, at least 500 or more residues.

Surface plasmon resonance: As used herein, refers to an optical phenomenon that allows for the analysis of specific binding interactions in real-time, for example through detection of alterations in protein concentrations within a biosensor matrix, such as by using a BlAcore system (Pharmacia Biosensor AB, Uppsala, Sweden and Piscataway, N.J.). For further descriptions, see Jonsson, U. et al., 1993, *Ann. Biol. Clin.* 51: 19-26; Jonsson, U. et al., 1991, *Biotechniques* 11: 620-627; Johnsson, B. et al., 1995, *J. Mol. Recognit.* 8: 125-131; and Johnnson, B. et al., 1991, *Anal. Biochem.* 198: 268-277.

Therapeutic agent: As used herein, generally refers to any agent that elicits a desired pharmacological effect when administered to an organism. In some embodiments, an agent is considered to be a therapeutic agent if it demonstrates a statistically significant effect across an appropriate population. In some embodiments, the appropriate population may be a population of model organisms. In some embodiments, an appropriate population may be defined by various criteria, such as a certain age group, gender, genetic background, preexisting clinical conditions, etc. In some embodiments, a therapeutic agent is a substance that can be used to alleviate, ameliorate, relieve, inhibit, prevent, delay onset of, reduce severity of, and/or reduce incidence of one or more symptoms or features of a disease, disorder, and/or condition. In some embodiments, a "therapeutic agent" is an agent that has been or is required to be approved by a government agency before it can be marketed for administration to humans. In some embodiments, a "therapeutic agent" is an agent for which a medical prescription is required for administration to humans.

Therapeutically effective amount: As used herein, is meant an amount that produces the desired effect for which it is administered. In some embodiments, the term refers to an amount that is sufficient, when administered to a population suffering from or susceptible to a disease, disorder, and/or condition in accordance with a therapeutic dosing regimen, to treat the disease, disorder, and/or condition. In some embodiments, a therapeutically effective amount is one that reduces the incidence and/or severity of, and/or delays onset of, one or more symptoms of the disease, disorder, and/or condition. Those of ordinary skill in the art will appreciate that the term "therapeutically effective amount" does not in fact require successful treatment be achieved in a particular individual. Rather, a therapeutically effective amount may be that amount that provides a particular desired pharmacological response in a significant number of subjects when administered to patients in need of such treatment. In some embodiments, reference to a therapeutically effective amount may be a reference to an amount as measured in one or more specific tissues (e.g., a tissue affected by the disease, disorder or condition) or fluids (e.g., blood, saliva, serum, sweat, tears, urine, etc.). Those of ordinary skill in the art will appreciate that, in some embodiments, a therapeutically effective amount of a particular agent or therapy may be formulated and/or administered in a single dose. In some embodiments, a therapeutically effective agent may be formulated and/or administered in a plurality of doses, for example, as part of a dosing regimen.

Treatment: As used herein, the term "treatment" (also "treat" or "treating"), in its broadest sense, refers to any administration of a substance (e.g., provided compositions) that partially or completely alleviates, ameliorates, relives, inhibits, delays onset of, reduces severity of, and/or reduces incidence of one or more symptoms, features, and/or causes of a particular disease, disorder, and/or condition. In some embodiments, such treatment may be administered to a subject who does not exhibit signs of the relevant disease, disorder and/or condition and/or of a subject who exhibits only early signs of the disease, disorder, and/or condition. Alternatively or additionally, in some embodiments, treatment may be administered to a subject who exhibits one or more established signs of the relevant disease, disorder and/or condition. In some embodiments, treatment may be of a subject who has been diagnosed as suffering from the relevant disease, disorder, and/or condition. In some embodiments, treatment may be of a subject known to have one or more susceptibility factors that are statistically correlated with increased risk of development of the relevant disease, disorder, and/or condition.

Variant: As used herein, the term "variant" refers to an entity that shows significant structural identity with a reference entity but differs structurally from the reference entity in the presence or level of one or more chemical moieties as compared with the reference entity. In many embodiments, a variant also differs functionally from its reference entity. In general, whether a particular entity is properly considered to be a "variant" of a reference entity is based on its degree of structural identity with the reference entity. As will be appreciated by those skilled in the art, any biological or chemical reference entity has certain characteristic structural elements. A variant, by definition, is a distinct chemical entity that shares one or more such characteristic structural elements. To give but a few examples, a polypeptide may have a characteristic sequence element comprised of a plurality of amino acids having designated positions relative to one another in linear or three-dimensional space and/or contributing to a particular biological function, a nucleic acid may have a characteristic sequence element comprised of a plurality of nucleotide residues having designated positions relative to on another in linear or three-dimensional space. For example, a variant polypeptide may differ from a reference polypeptide as a result of one or more differences in amino acid sequence and/or one or more differences in chemical moieties (e.g., carbohydrates, lipids, etc.) covalently attached to the polypeptide backbone. In some embodiments, a variant polypeptide shows an overall sequence identity with a reference polypeptide that is at least 85%, 86%, 87%, 88%, 89%, 90%, 91%, 92%, 93%, 94%, 95%, 96%, 97%, or 99%. Alternatively or additionally, in some embodiments, a variant polypeptide does not share at least one characteristic sequence element with a reference polypeptide.

In some embodiments, the reference polypeptide has one or more biological activities. In some embodiments, a variant polypeptide shares one or more of the biological activities of the reference polypeptide. In some embodiments, a variant polypeptide lacks one or more of the biological activities of the reference polypeptide. In some embodiments, a variant polypeptide shows a reduced level of one or more biological activities as compared with the reference polypeptide. In many embodiments, a polypeptide of interest is considered to be a "variant" of a parent or reference polypeptide if the polypeptide of interest has an amino acid sequence that is identical to that of the parent but for a small number of sequence alterations at particular positions. Typically, fewer than 20%, 15%, 10%, 9%, 8%, 7%, 6%, 5%, 4%, 3%, 2% of the residues in the variant are substituted as compared with the parent. In some embodiments, a variant has 10, 9, 8, 7, 6, 5, 4, 3, 2, or 1 substituted residue as compared with a parent. Often, a variant has a very small number (e.g., fewer than 5, 4, 3, 2, or 1) number of substituted functional residues (i.e., residues that participate in a particular biological activity). Furthermore, a variant typically has not more than 5, 4, 3, 2, or 1 insertions or deletions, and often has no insertions or deletions, as compared with the parent. Moreover, any additions or deletions are typically fewer than about 25, about 20, about 19, about 18, about 17, about 16, about 15, about 14, about 13, about 10, about 9, about 8, about 7, about 6, and commonly are fewer than about 5, about 4, about 3, or about 2 residues. In some embodiments, the parent or reference polypeptide is one found in nature. As will be understood by those of ordinary skill in the art, a plurality of variants of a particular polypeptide of interest may commonly be found in nature, particularly when the polypeptide of interest is an infectious agent polypeptide.

Vector: As used herein, refers to a nucleic acid molecule capable of transporting another nucleic acid to which it has been linked. One type of vector is a "plasmid", which refers to a circular double stranded DNA loop into which additional DNA segments may be ligated. Another type of vector is a viral vector, wherein additional DNA segments may be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) can be integrated into the genome of a host cell upon introduction into the host cell, and thereby are replicated along with the host genome. Moreover, certain vectors are capable of directing the expression of genes to which they are operatively linked. Such vectors are referred to herein as "expression vectors."

Wild type: As used herein, the term "wild type" has its art-understood meaning that refers to an entity having a structure and/or activity as found in nature in a "normal" (as contrasted with mutant, variant, diseased, altered, etc.) state or context. Those of ordinary skill in the art will appreciate that wild type genes and polypeptides often exist in multiple different forms (e.g., alleles).

BRIEF DESCRIPTION OF THE DRAWINGS

FIGS. 1A-1E show representative MFI of commercial mouse anti-human CD22 antibody (Biolegend, Cat. No. 363505) binding to full-length CD22 only. Full-length CD22 is expressed in Jurkat cells (FIG. 1B) and Raji cells (FIG. 1D).

FIGS. 4A-4C illustrate that anti-CD22 CAR (clone 2) displayed specific and potent killing activity against CD22$^+$ target cells as measured by IFN-γ release assays.

FIGS. 9A and 9B show that anti-CD22-caTCR T cells expressing any one of the constructs 2 and 4 and construct combinations 3, 5, and 6 maintained high killing efficacy in NALM6 cells up to at least three weeks and after three or more rounds of target engagements. FIG. 9A shows target cell numbers and FIG. 9B shows total cell numbers.

FIGS. 10A and 10B show that anti-CD22-caTCR T cells expressing any one of the constructs 2 and 4 and construct combinations 1, 3, 5, and 6 had significant killing efficacy in Raji cells up to about five weeks and after a total of five rounds of target engagements.

DETAILED DESCRIPTION OF THE EMBODIMENTS

Figure 2A:
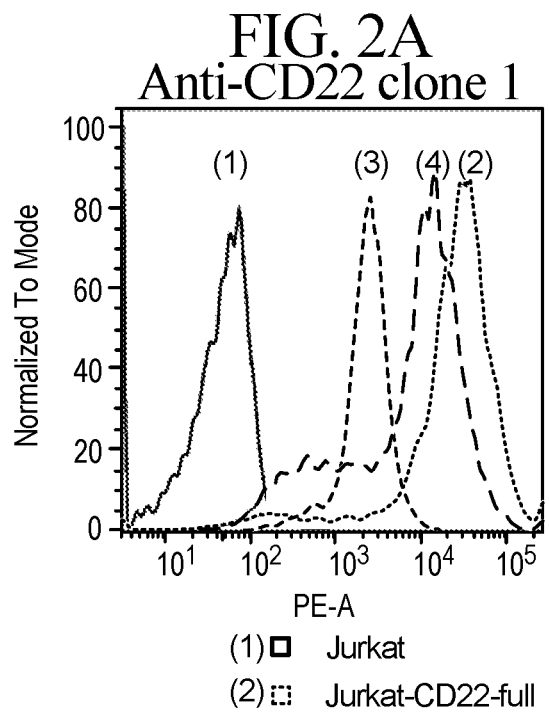
FIGS. 2A and 2B show representative MFI of phage clones 1 and 2 binding of human CD22$^+$ Raji cells (Raji) and Jurkat cells expressing full-length CD22 (Jurkat-CD22-full) or domains 5-7 of CD22 (Jurkat-CD22 (D5-D7)-GFP) in a flow cytometry assay. CD22− Jurkat cells were used as a negative control.

The present invention relates to the discovery of anti-CD22 constructs that have the ability to specifically bind to an extracellular region of CD22. The invention also provides the use of such constructs to treat B-cell malignancies (e.g., CD22+ B-cell malignancies).

I. CD22

Cluster of Differentiation 22, or CD22, is a 135-kDa sialic acid-binding cell-surface receptor expressed exclusively during the mature stages of differentiation of the B-cell (Dorken., *J. Immunol.* 136: 4470, 1986). The predominant form of CD22 in humans is CD22 beta, which contains seven domains (Wilson et al., *J. Exp. Med.* 173: 137, 1991). A variant form, CD22 alpha, lacks domains 3 and 4 (Stamenkovic and Seed, *Nature* 345: 74, 1990). Ligand-binding to human CD22 has been shown to be associated with domains 1 and 2 (also referred to as epitopes 1 and 2) (Engel et al., *J. Exp. Med.* 181: 1581, 1995). The amino acid sequence of full-length human CD22 is shown in SEQ ID NO: 204 below. SEQ ID NO: 205 further shows the extracellular region containing domains 5-7 of CD22, which anti-CD22 clone 1 and clone 2 bind (see Example 1). Anti-CD22 clone 1 comprises LC-CDR1-3 having the sequences of SEQ ID NOS: 206-208, respectively, and HC-CDR1-3 having the sequences of SEQ ID NOS: 209-211, respectively. Anti-CD22 clone 2 comprises LC-CDR1-3 having the sequences of SEQ ID NOS: 214-216, respectively, and HC-CDR1-3 having the sequences of SEQ ID NOS: 209, 210, and 217, respectively.

SEQ ID NO: 204 (full-length human CD22; underlined: portion of CD22 used in phage display as described in Example 1; bold and underlined: transmembrane domain of CD22):

MHLLGPWLLLLVLEYLAFSDSSKWVFEHPETLYAWEGACVWIPCTYRALD

GDLESFILFHNPEYNKNTSKFDGTRLYESTKDGKVPSEQKRVQFLGDKNK

NCTLSIHPV<sub>H</sub>LNDSGQLGLRMESKTEKWMERIHLNVSERPFPPHIQLPPE

IQESQEVTLTCLLNFSCYGYPIQLQWLLEGVPMRQAAVTSTSLTIKSVFT

RSELKFSPQWSHEIGKIVTCQLQDADGKFLSNDTVQLNVKHTPKLEIKVT

PSDAIVREGDSVTMTCEVSSSNPEYTTVSWLKDGTSLKKQNTFTLNLREV

TKDQSGKYCCQVSNDVGPGRSEEVFLQVQYAPEPSTVQILHSPAVEGSQV

EFLCMSLANPLPTNYTWYHNGKEMQGRTEEKV<sub>H</sub>IPKILPWHAGTYSCVAE

NILGTGQRGPGAEL<u>DVQYPPKKVTTVIQNPMPIREGDTVTLSCNYNSSNP

SVTRYEWKPHGAWEEPSLGVLKIQNVGWDNTTIACAACNSWCSWASPVAL

NVQYAPRDVRVRKIKPLSEIHSGNSVSLQCDFSSSHPKEVQFFWEKNGRL

LGKESQLNFDSISPEDAGSYSCWVNNSIGQTASKAWTLEVLYAPRRLRVS

MSPGDQVNIEGKSATLTCESDANPPVSHYTWFDWNNQSLPYHSQKLRLEP

VKVQHSGAYWCQGTNSVGKGRSPLSTLTVYYSPETIGRR</u>VAVGLGSCLAI

LILAICGLKLQRRWKRTQSQQGLQENSSGQSFFVRNKKVRRAPLSEGPHS

LGCYNPMMEDGISYTTLRFPEMNIPRTGDAESSEMQRPPPDCDDTVTYSA

LHKRQVGDYENVIPDFPEDEGIHYSELIQFGVGERPQAQENVDYVILKH

SEQ ID NO: 205 (extracellular region containing domains 5-7 of CD22; corresponding to amino acids 414-687 of SEQ ID NO: 204):

DVQYPPKKVTTVIQNPMPIREGDTVTLSCNYNSSNPSVTRYEWKPHGAWE

EPSLGVLKIQNVGWDNTTIACAACNSWCSWASPVALNVQYAPRDVRVRKI

KPLSEIHSGNSVSLQCDFSSSHPKEVQFFWEKNGRLLGKESQLNFDSISP

EDAGSYSCWVNNSIGQTASKAWTLEVLYAPRRLRVSMSPGDQVMEGKSAT

LTCESDANPPVSHYTWFDWNNQSLPYHSQKLRLEPVKVQHSGAYWCQGTN

SVGKGRSPLSTLTVYYSPETIGRR

CD22 has been implicated in various cancers, e.g., B-cell related cancers. B-cell related cancers include, but are not limited to, malignant lymphoma (non-Hodgkin's lymphoma), multiple myeloma, and chronic lymphocytic leukemia (CLL, B-cell leukemia (CD5+ B lymphocytes)). CD22 expression was recapitulated in human acute lymphoblastic leukemia (ALL)-murine xenografts established with limiting dilution studies, which raises the possibility that CD22 may be expressed on leukemia-initiating cells (Morisot et al., *Leukemia* 24: 1859, 2010). Furthermore, CD22 expression was found to be maintained in serial studies of 45 patients, including 39 treated with anti-CD22 directed therapy, suggesting that the development of CD22⁻ B-cell precursor acute lymphoblastic leukemia (BCP-ALL) is uncommon (Morisot et al., *Leukemia* 24: 1859, 2010). The suitability of targeting CD22 in BCP-ALL was tested (Haso et al., *Blood* 121: 1165, 2013). Lymphoblasts from 111 patients with BCP-ALL were assayed for CD22 expression and all were found to be CD22-positive, with median CD22 expression levels of 3500 sites/cell.

Moreover, CD22 is highly expressed in over 90% of non-Hodgkin's lymphoma populations (Cesano et al., *Blood* 100: 350a, 2002). NHLs, a heterogeneous group of cancers principally arising from B lymphocytes, represent approximately 4% of all newly diagnosed cancers (Jemal et al., *CA Cancer J Clin*, 52: 23, 2002). Aggressive NHL comprises approximately 30-40% of adult NHL (Harris et al., *Hematol J.* 1:53, 2001) and includes diffuse large B-cell lymphoma (DLBCL), mantle cell lymphoma (MCL), peripheral T-cell lymphoma, and anaplastic large cell lymphoma. Frontline combination chemotherapy may only treat less than half of the patients with aggressive NHL, and most patients eventually succumb to their disease (Fisher, *Oncol.* 27 (suppl 12): 2, 2000). There is also evidence that CD22 expression may allow B-cells to become tumorigenic by preventing apoptosis (Otipoby et al., *Nature (Lond)* 384:634, 1996). CD22 may function both as a component of the B-cell activation complex (Sato et al., *Semin. Immunol.* 10: 287, 1998) and as an adhesion molecule (Engel et al., *J. Immunol.* 150:4719, 1993). After binding with its natural ligands, CD22 is rapidly internalized, providing a co-stimulatory signal in primary B-cells and proapoptotic signals in neoplastic B-cells (Sato et al., *Immunity* 5: 551, 1996).

II. Anti-CD22 Constructs and Construct Combinations

In one aspect, the present invention provides anti-cluster of differentiation-22 (CD22) constructs that comprise an antibody moiety that specifically binds to CD22 (i.e., binds to the sequence of SEQ ID NO: 205 or a portion thereof). In some embodiments, the anti-CD22 construct is an isolated anti-CD22 construct. The specificity of the anti-CD22 construct derives from an anti-CD22 antibody moiety, such as a full-length antibody or antigen-binding fragment thereof, that specifically binds to the CD22 (i.e., binds to the sequence of SEQ ID NO: 205 or a portion thereof). Contemplated anti-CD22 constructs include, for example, full-length anti-CD22 antibodies, multispecific (such as bispecific) anti-CD22 antibodies, anti-CD22 chimeric antigen receptors (CARs), anti-CD22 chimeric antibody-T cell receptors (caTCRs), anti-CD22 chimeric co-stimulatory receptors (CSRs), and anti-CD22 immunoconjugates. An anti-CD22 construct described herein may comprise an antibody moiety that is a full-length anti-CD22 antibody or multispecific (such as bispecific) anti-CD22 antibody. In some embodiments, an anti-CD22 construct described herein may be an antibody moiety that is a full-length anti-CD22 antibody or multispecific (such as bispecific) anti-CD22 antibody. In some embodiments, an anti-CD22 construct described herein may be an anti-CD22 chimeric antigen receptors (CAR) or anti-CD22 immunoconjugate.

In some embodiments, the anti-CD22 constructs can be multispecific (e.g., bispecific). Multispecific anti-CD22 constructs have antibody moieties against more than one target. In some embodiments, a multispecific anti-CD22 constructs has one antibody moiety against CD22 and one or more additional antibody moieties against one or more non-CD22 antigens (e.g., CD19, CD20, a non-CD22 antigen expressed in B-cell malignancy). In some embodiments, a multispecific anti-CD22 construct can be bispecific, trispecific, quad-specific, or quint-specific. In some embodiments, a multispecific anti-CD22 construct can be a caTCR, a CSR, a CAR, a full-length antibody, a Fab, a Fab', a F(ab')2, an Fv, a single chain Fv (scFv) antibody, a tandem scFv, a diabody (Db), a single chain diabody (scDb), a dual-affinity retargeting (DART) antibody, a dual variable domain (DVD) antibody, a knob-into-hole (KiH) antibody, a dock and lock (DNL) antibody, a chemically cross-linked antibody, a heteromultimeric antibody, or a heteroconjugate antibody.

The present invention provides anti-CD22 constructs and methods for using such antibodies for treating CD22-associated diseases. In some embodiments, an anti-CD22 construct described herein recognizes and bind to an epitope within the sequence of SEQ ID NO: 205. An anti-CD22 construct may bind to an epitope comprising at least 7 amino acids (e.g., at least 8, 10, 12, 14, 16, 18, 20, 22, 24, 26, 28, 30, 32, 34, 36, 38, or 40 amino acids) within the sequence of SEQ ID NO: 205. In some embodiments, an anti-CD22 construct may bind to an epitope comprising at least 7 contiguous amino acids (e.g., at least 8, 10, 12, 14, 16, 18, 20, 22, 24, 26, 28, 30, 32, 34, 36, 38, or 40 amino acids) within the sequence of SEQ ID NO: 2. In some embodiments, an anti-CD22 construct described herein binds to the sequence of SEQ ID NO: 205. An anti-CD22 construct described herein may comprise an antibody moiety that is a full-length antibody, a Fab, a Fab', a F(ab')2, an Fv, a single chain Fv (scFv) antibody. In some embodiments, an anti-CD22 construct described herein may be a full-length antibody, a Fab, a Fab', a F(ab')2, an Fv, a single chain Fv (scFv) antibody. In some embodiments, an anti-CD22 construct described herein may be an scFv antibody. In some embodiments, an anti-CD22 construct described herein may comprise an antibody moiety that is a member of an antibody class (i.e., isotype) selected from the group consisting of IgG, IgM, IgA, IgD, IgE, or a fragment thereof.

An anti-CD22 construct may comprise an antibody moiety that specifically binds to CD22, wherein the antibody moiety comprises one or more CDRs, heavy chain variable region, and/or light chain variable region as described herein. In one embodiment, an anti-CD22 construct that specifically binds to CD22 (i.e., binds to the sequence of SEQ ID NO: 205 or a portion thereof) comprises an antibody moiety, wherein the antibody moiety comprises: (1) a light chain variable region comprising a light chain complementarity determining region (LC-CDR) 1, a LC-CDR2, and a LC-CDR3, and (2) a heavy chain variable region comprising a heavy chain complementarity determining region (HC-CDR) 1, an HC-CDR2, and an HC-CDR3, and wherein the antibody moiety comprises one or more of: the LC-CDR1 having the sequence of SSNIGNNY (SEQ ID NO: 206), the LC-CDR2 having the sequence of ENN (SEQ ID NO: 207), the LC-CDR3 having the sequence of GTWDSSLSAGAV (SEQ ID NO: 208), the HC-CDR1 having the sequence of GFTFSNYA (SEQ ID NO: 209), the HC-CDR2 having the sequence of ISGSGGST (SEQ ID NO: 210), and the HC-CDR3 having the sequence of ARPYYDD (SEQ ID NO: 211). In some embodiments, the antibody moiety comprises the sequences of SEQ ID NOS: 206-211.

In some embodiments, an antibody moiety in an anti-CD22 construct described herein having LC-CDR1 of the sequence of SEQ ID NO: 206, LC-CDR2 of the sequence of SEQ ID NO: 207, and LC-CDR3 of the sequence of SEQ ID NO: 208 may comprise a light chain variable region having a sequence that has at least 90% identity (e.g., at least 92%, 94%, 96%, 98%, or 99% identity) to the sequence of QSVVTQPPSVSAAPGQKVTISCSGSSS-NIGNNYVSWYQQLPGTAPKLLIYENNKRPSG IPDRFSGSKSGTSATLGITGLQTGDEADYYCGTWDS SLSAGAVFGGGTKLTKLTVLG (SEQ ID NO: 212). In some embodiments, the light chain variable region (e.g., SEQ ID NO: 212) may further be humanized. For example, the light chain variable region may comprise non-human CDRs and framework regions and/or constant regions that are humanized or derived from human antibody sequences. In particular embodiments, the light chain variable region comprises the sequence of SEQ ID NO: 212. In some embodiments, the light chain of the anti-CD22 construct having the LC-CDR1, LC-CDR2, and LC-CDR3 of the sequences of SEQ ID NOS: 206-208, respectively, is a light chain of the lambda isotype.

In some embodiments, an antibody moiety in an anti-CD22 construct described herein having HC-CDR1 of the sequence of SEQ ID NO: 209, HC-CDR2 of the sequence of SEQ ID NO: 210, and HC-CDR3 of the sequence of SEQ ID NO: 211 may comprise a heavy chain variable region having a sequence that has at least 90% identity (e.g., at least 92%, 94%, 96%, 98%, or 99% identity) to the sequence of EVQLVESGGGLVQPGGSLRLSCAASGFTFSNYAM-SWVRQAPGKGLEWVSAISGSGG STYYAD SVKGRFTISRDNSKNTLYLQMNSLRAEDTAVYY-CARPYYDDWGQGTLVT VSS (SEQ ID NO: 213). In some embodiments, the heavy chain variable region (e.g., SEQ ID NO: 213) may further be humanized. For example, the heavy chain variable region may comprise non-human CDRs and framework regions and/or constant regions that are humanized or derived from human antibody sequences. In particular embodiments, the heavy chain variable region comprises the sequence of SEQ ID NO: 213.

In another embodiment, an anti-CD22 construct that specifically binds to CD22 (i.e., binds to the sequence of SEQ ID NO: 205 or a portion thereof) comprises an antibody moiety, wherein the antibody moiety comprises: (1) a light chain variable region comprising a light chain complementarity determining region (LC-CDR) 1, a LC-CDR2, and a LC-CDR3, and (2) a heavy chain variable region comprising a heavy chain complementarity determining region (HC-CDR) 1, an HC-CDR2, and an HC-CDR3, and wherein the antibody moiety comprises one or more of: the LC-CDR1 having the sequence of HDIRNY (SEQ ID NO: 214), the LC-CDR2 having the sequence of AAS (SEQ ID NO: 215), the LC-CDR3 having the sequence of QQYDGLPLT (SEQ ID NO: 216), the HC-CDR1 having the sequence of GFTFSNYA (SEQ ID NO: 209), the HC-CDR2 having the sequence of ISGSGGST (SEQ ID NO: 210), and the HC-CDR3 having the sequence of ARYGSAAWMDS (SEQ ID NO: 217). In some embodiments, the antibody moiety comprises the sequences of SEQ ID NOS: 209, 210, 214-217.

In some embodiments, an antibody moiety in an anti-CD22 construct described herein having LC-CDR1 of the sequence of SEQ ID NO: 214, LC-CDR2 of the sequence of SEQ ID NO: 215, and LC-CDR3 of the sequence of SEQ ID NO: 216 may comprise a light chain variable region having a sequence that has at least 90% identity (e.g., at least 92%, 94%, 96%, 98%, or 99% identity) to the sequence of DIQLTQSPSSLSTSVGDRVTITCQASHDIR-NYLNWYQQKPGKAPNLLIYAASNLQTGV PSRF SGRGSGTDFTLTIS SLQPEDIATYYCQQYDG-LPLTFGQGTRLEIKR (SEQ ID NO: 218). In some embodiments, the light chain variable region (e.g., SEQ ID NO: 218) may further be humanized. For example, the light chain variable region may comprise non-human CDRs and framework regions and/or constant regions that are humanized or derived from human antibody sequences. In particular embodiments, the light chain variable region comprises the sequence of SEQ ID NO: 218. In some embodiments, the light chain of the anti-CD22 construct having the LC-CDR1, LC-CDR2, and LC-CDR3 of the sequences of SEQ ID NOS: 214-216, respectively, is a light chain of the lambda isotype.

In some embodiments, an antibody moiety in an anti-CD22 construct described herein having HC-CDR1 of the sequence of SEQ ID NO: 209, HC-CDR2 of the sequence of SEQ ID NO: 210, and HC-CDR3 of the sequence of SEQ ID NO: 217 may comprise a heavy chain variable region having a sequence that has at least 90% identity (e.g., at least 92%, 94%, 96%, 98%, or 99% identity) to the sequence of QVQLVESGGGLVQPGGSLRLSCAASGFTFSNYAM-SWVRQAPGKGLEWVSSISGSGG STYY-ADSVKGRFTISRDTSKNTLYLQMNSLRAEDTAVYY-CARYGSAAWMDSWGQG TLVTVSS (SEQ ID NO: 219). In some embodiments, the heavy chain variable region (e.g., SEQ ID NO: 219) may further be humanized. For example, the heavy chain variable region may comprise non-human CDRs and framework regions and/or constant regions that are humanized or derived from human antibody sequences. In particular embodiments, the heavy chain variable region comprises the sequence of SEQ ID NO: 219.

The invention also includes an anti-CD22 construct that comprises an antibody moiety that competes for binding with an antibody moiety having LC-CDR1, LC-CDR2, and LC-CDR3 having the sequences of SEQ ID NOS: 206-208, respectively, and HC-CDR1, HC-CDR2, and HC-CDR3 having the sequences of SEQ ID NOS: 209-211, respectively. The invention also includes an anti-CD22 construct that comprises an antibody moiety that competes for binding with an antibody moiety having a light chain variable region having a sequence of SEQ ID NO: 212 and a heavy chain variable region having a sequence of SEQ ID NO: 213. A skilled artisan in the field has the general knowledge, skills, and methods to identify such competing antibody moieties.

The invention also includes an anti-CD22 construct that comprises an antibody moiety that competes for binding with an antibody moiety having LC-CDR1, LC-CDR2, and LC-CDR3 having the sequences of SEQ ID NOS: 214-216, respectively, and HC-CDR1, HC-CDR2, and HC-CDR3 having the sequences of SEQ ID NOS: 209, 210, and 217, respectively. The invention also includes an anti-CD22 construct that comprises an antibody moiety that competes for binding with an antibody moiety having a light chain variable region having a sequence of SEQ ID NO: 218 and a heavy chain variable region having a sequence of SEQ ID NO: 219. A skilled artisan in the field has the general knowledge, skills, and methods to identify such competing antibody moieties.

Single Chain Variable Fragment (scFv) Antibodies

An anti-CD22 construct described herein may comprise an antibody moiety that is a single chain Fv (scFv) antibody. In some embodiments, an anti-CD22 construct described herein may be an scFv antibody. An scFv antibody may comprise a light chain variable region and a heavy chain variable region, in which the light chain variable region and the heavy chain variable region may be joined using recombinant methods by a synthetic linker to make a single polypeptide chain. In some embodiments, the scFv may have the structure "(N-terminus) light chain variable region-linker-heavy chain variable region (C-terminus)," in which the heavy chain variable region is joined to the C-terminus of the light chain variable region by way of a linker. In other embodiments, the scFv may have the structure "(N-terminus) heavy chain variable region-linker-light chain variable region (C-terminus)," in which the light chain variable region is joined to the C-terminus of the heavy chain variable region by way of a linker. A linker may be a polypeptide including 2 to 200 (e.g., 2, 3, 5, 10, 15, 20, 25, 30, 35, 40, 45, 50, 55, 60, 65, 70, 75, 80, 85, 90, 95, 100, 110, 120, 130, 140, 150, 160, 170, 180, 190, or 200) amino acids. Suitable linkers may contain flexible amino acid residues such as glycine and serine. In certain embodiments, a linker may contain motifs, e.g., multiple or repeating motifs, of GS, GGS, GGGGS (SEQ ID NO: 220), GGSG (SEQ ID NO: 221), or SGGG (SEQ ID NO: 222). In some embodiments, a linker may have the sequence GSGS (SEQ ID NO: 223), GSGSGS (SEQ ID NO: 224), GSGSGSGS (SEQ ID NO: 225), GSGSGSGSGS (SEQ ID NO: 226), GGSGGS (SEQ ID NO: 227), GGSGGSGGS (SEQ ID NO: 228), GGSGGSGGSGGS (SEQ ID NO: 229). GGSG (SEQ ID NO: 230), GGSGGGSG (SEQ ID NO: 231), or GGSGGGSGGGSG (SEQ ID NO: 232). In other embodiments, a linker may also contain amino acids other than glycine and serine, e.g., SRGGGGSGGGGSGGGGSLEMA (SEQ ID NO: 233).

Purification Tag

In some embodiments, a purification tag may be joined to an anti-CD22 construct described herein (e.g., an anti-CD22 scFv). A purification tag refers to a peptide of any length that can be used for purification, isolation, or identification of a polypeptide. A purification tag may be joined to a polypeptide (e.g., joined to the N- or C-terminus of the polypeptide) to aid in purifying the polypeptide and/or isolating the polypeptide from, e.g., a cell lysate mixture. In some embodiments, the purification tag binds to another moiety that has a specific affinity for the purification tag. In some embodiments, such moieties which specifically bind to the purification tag are attached to a solid support, such as a matrix, a resin, or agarose beads. Examples of a purification tag that may be joined to an anti-CD22 construct (e.g., an anti-CD22 scFv) include, but are not limited to, a hexa-histidine peptide, a hemagglutinin (HA) peptide, a FLAG peptide, and a myc peptide. In some embodiments, two or more purification tag may be joined to a construct, e.g., a hexa-histidine peptide and a HA peptide. A hexa-histidine peptide (HHHHHH (SEQ ID NO: 234)) binds to nickelfunctionalized agarose affinity column with micromolar affinity. In some embodiments, an HA peptide includes the sequence YPYDVPDYA (SEQ ID NO: 235) or YPYDVPDYAS (SEQ ID NO: 236). In some embodiments, an HA peptide includes integer multiples of the sequence YPYDVPDYA (SEQ ID NO: 235) or YPYDVPDYAS (SEQ ID NO: 236) in tandem series, e.g., 3×YPYDVPDYA or 3×YPYDVPDYAS. In some embodiments, a FLAG peptide includes the sequence DYKDDDDK (SEQ ID NO: 237). In some embodiments, a FLAG peptide includes integer multiples of the sequence DYKDDDDK (SEQ ID NO: 237) in tandem series, e.g., 3×DYKDDDDK. In some embodiments, a myc peptide includes the sequence EQKLISEEDL (SEQ ID NO: 238). In some embodiments, a myc peptide includes integer multiples of the sequence EQKLISEEDL in tandem series, e.g., 3×EQKLISEEDL.

Anti-CD22 scFv Antibodies

In some embodiments, an anti-CD22 construct having the LC-CDR1, LC-CDR2, LC-CDR3, HC-CDR1, HC-CDR2, and HC-CDR3 of the sequences of SEQ ID NOS: 206-211, respectively, may be an scFv antibody. In some embodiments, the heavy chain variable region having at least 90% identity (e.g., at least 92%, 94%, 96%, 98%, or 99% identity) to the sequence of SEQ ID NO: 213 may be joined to the N- or C-terminus of the light chain variable region having at least 90% identity (e.g., at least 92%, 94%, 96%, 98%, or 99% identity) to the sequence of SEQ ID NO: 212 by way of a linker. In particular embodiments, the anti-CD22 scFv antibody has the sequence of SEQ ID NO: 239 shown below. SEQ ID NO: 239 (anti-CD22 scFv antibody; plain text (no bold or underline): light chain variable region and heavy chain variable region; bold: linker; and underlined: purification tags (hexa-histidine tag and HA tag)

QSVVTQPPSVSAAPGQKVTISCSGSSSNIGNNYVSWYQQLPGTAPKLLIY

ENNKRPSGIPDRFSGSKSGTSATLGITGLQTGDEADYYCGTWDSSLSAGA

VFGGGTKLTVLGSRGGGSGGGGSGGGGSLEMAEVQLVESGGGLVQPGGS

LRLSCAASGFTFSNYAMSWVRQAPGKGLEWVSAISGSGGSTYYADSVKGR

FTISRDNSKNTLYLQMNSLRAEDTAVYYCARPYYDDWGQGTLVTVSSTSG

QAGQ<u>HHHHHH</u>GA<u>YPYDVPDYAS</u>

In some embodiments, an anti-CD22 construct having the LC-CDR1, LC-CDR2, LC-CDR3, HC-CDR1, HC-CDR2, and HC-CDR3 of the sequences of SEQ ID NOS: 214-216, 209, 210, and 217, respectively, may be an scFv antibody. In some embodiments, the heavy chain variable region having at least 90% identity (e.g., at least 92%, 94%, 96%, 98%, or 99% identity) to the sequence of SEQ ID NO: 219 may be joined to the N- or C-terminus of the light chain variable region having at least 90% identity (e.g., at least 92%, 94%, 96%, 98%, or 99% identity) to the sequence of SEQ ID NO: 218 by way of a linker. In particular embodiments, the anti-CD22 scFv antibody has the sequence of SEQ ID NO: 240 shown below. SEQ ID NO: 240 (anti-CD22 scFv antibody; plain text (no bold or underline): light chain variable region and heavy chain variable region; bold: linker; and underlined: purification tags (hexa-histidine tag and HA tag)

DIQLTQSPSSLSTSVGDRVTITCQASHDIRNYLNWYQQKPGKAPNLLIYA

ASNLQTGVPSRFSGRGSGTDFTLTISSLQPEDIATYYCQQYDGLPLTFGQ

GTRLEIKRSRGGGSGGGGSGGGGSLEMAQVQLVESGGGLVQPGGSLRLS

CAASGFTFSNYAMSWVRQAPGKGLEWVSSISGSGGSTYYADSVKGRFTIS

RDTSKNTLYLQMNSLRAEDTAVYYCARYGSAAWMDSWGQGTLVTVSSTSG

QAGQ<u>HHHHHH</u>GA<u>YPYDVPDYAS</u>

Multispecific Antibodies

Anti-CD22 constructs described herein may comprise an antibody moiety that is a multispecific antibody. In some embodiments, an anti-CD22 construct described herein may be a multispecific antibody. A multispecific antibody may comprise an anti-CD22 binding moiety and a second binding moiety (such as a second antigen-binding moiety). Multispecific antibodies are antibodies that have binding specificities for at least two different antigens or epitopes (e.g., bispecific antibodies have binding specificities for two antigens or epitopes). Multispecific antibodies with more than two specificities are also contemplated. For example, trispecific antibodies can be prepared (see, e.g., Tutt et al. *J. Immunol.* 147: 60 (1991)). It is to be appreciated that one of skill in the art could select appropriate features of individual multispecific antibodies described herein to combine with one another to form a multispecific antibodies of the invention.

Thus, for example, in some embodiments, there is provided a multispecific (e.g., bispecific) anti-CD22 antibody comprising a) an anti-CD22 binding moiety that specifically binds to an extracellular region of CD22 (i.e., binds to the sequence of SEQ ID NO: 205 or a portion thereof), and b) a second binding moiety (such as an antigen-binding moiety). In some embodiments, the second binding moiety specifically binds to a different antigen. In some embodiments, the second binding moiety specifically binds to an antigen on the surface of a cell, such as a cytotoxic cell. In some embodiments, the second binding moiety specifically binds to an antigen on the surface of a lymphocyte, such as a T cell, an NK cell, a neutrophil, a monocyte, a macrophage, or a dendritic cell. In some embodiments, the second binding moiety specifically binds to an effector T cell, such as a cytotoxic T cell (also known as cytotoxic T lymphocyte (CTL) or T killer cell).

In some embodiments, the second binding moiety specifically binds to a tumor antigen. Examples of tumor antigens include, but are not limited to, alpha fetoprotein (AFP), CA15-3, CA27-29, CA19-9, CA-125, calretinin, carcinoembryonic antigen, CD34, CD99, CD117, chromogranin, cytokeratin, desmin, epithelial membrane protein (EMA), Factor VIII, CD31 FL1, glial fibrillary acidic protein (GFAP), gross cystic disease fluid protein (GCDFP-15), HMB-45, human chorionic gonadotropin (hCG), inhibin, keratin, CD45, a lymphocyte marker, MART-1 (Melan-A), Myo D1, muscle-specific actin (MSA), neurofilament, neuron-specific enolase (NSE), placental alkaline phosphatase (PLAP), prostate-specific antigen, S100 protein, smooth muscle actin (SMA), synaptophysin, thyroglobulin, thyroid transcription factor-1, tumor M2-PK, and vimentin.

In some embodiments, the second antigen-binding moiety in a bispecific antibody binds to CD3. In some embodiments, the second antigen-binding moiety specifically binds to CD3ε. In some embodiments, the second antigen-binding moiety specifically binds to an agonistic epitope of CD3ε. The term "agonistic epitope", as used herein, means (a) an epitope that, upon binding of the multispecific antibody, optionally upon binding of several multispecific antibodies on the same cell, allows said multispecific antibodies to activate T cell receptor (TCR) signaling and induce T cell activation, and/or (b) an epitope that is solely composed of amino acid residues of the epsilon chain of CD3 and is accessible for binding by the multispecific antibody, when presented in its natural context on T cells (i.e. surrounded by the TCR, the CD3γ chain, etc.), and/or (c) an epitope that, upon binding of the multispecific antibody, does not lead to stabilization of the spatial position of CD3ε relative to CD3γ.

In some embodiments, the second antigen-binding moiety binds specifically to an antigen on the surface of an effector cell, including for example CD3γ, CD3δ, CD3ε, CD3ζ, CD28, CD16a, CD56, CD68, GDS2D, CD3γ, CD3δ, CD3ε, CD3ζ, CD28, CD16a, CD56, CD68, GDS2D, OX40, GITR, CD137, CD27, CD40L and HVEM. In other embodiments, the second antigen-binding moiety binds to a component of the complement system, such as C1q. C1q is a subunit of the C1 enzyme complex that activates the serum complement system. In other embodiments, the second antigen-binding moiety specifically binds to an Fc receptor. In some embodiments, the second antigen-binding moiety specifically binds to an Fcγ receptor (FcγR). The FcγR may be an FcγRIII present on the surface of natural killer (NK) cells or one of FcγRI, FcγRIIA, FcγRIIBI, FcγRIIB2, and FcγRIIIB present on the surface of macrophages, monocytes, neutrophils and/or dendritic cells. In some embodiments, the second antigen-binding moiety is an Fc region or functional fragment thereof. A "functional fragment" as used in this context refers to a fragment of an antibody Fc region that is still capable of binding to an FcR, in particular to an FcγR, with sufficient specificity and affinity to allow an FcγR bearing effector cell, in particular a macrophage, a monocyte, a neutrophil and/or a dendritic cell, to kill the target cell by cytotoxic lysis or phagocytosis. A functional Fc fragment is capable of competitively inhibiting the binding of the original, full-length Fc portion to an FcR such as the activating FcγRI. In some embodiments, a functional Fc fragment retains at least 30%, 40%, 50%, 60%, 70%, 80%, 90% or 95% of its affinity to an activating FcγR. In some embodiments, the Fc region or functional fragment thereof is an enhanced Fc region or functional fragment thereof. The term "enhanced Fc region", as used herein, refers to an Fc region that is modified to enhance Fc receptor-mediated effector-functions, in particular antibody-dependent cell-mediated cytotoxicity (ADCC), complement-dependent cytotoxicity (CDC), and antibody-mediated phagocytosis. This can be achieved as known in the art, for example by altering the Fc region in a way that leads to an increased affinity for an activating receptor (e.g. FcγRIIIA (CD16A) expressed on natural killer (NK) cells) and/or a decreased binding to an inhibitory receptor (e.g. FcγRIIB1/B2 (CD32B)).

In some embodiments, the multispecific anti-CD22 antibodies allow killing of CD22-presenting target cells and/or can effectively redirect CTLs to lyse CD22-presenting target cells. In some embodiments, the multispecific (e.g., bispecific) anti-CD22 antibodies of the present invention show an in vitro EC50 ranging from 10 to 500 ng/ml, and is able to induce redirected lysis of about 50% of the target cells through CTLs at a ratio of CTLs to target cells of from about 1:1 to about 50:1 (such as from about 1:1 to about 15:1, or from about 2:1 to about 10:1).

In some embodiments, the multispecific (e.g., bispecific) anti-CD22 antibody is capable of cross-linking a stimulated or unstimulated CTL and the target cell in such a way that the target cell is lysed. This offers the advantage that no generation of target-specific T cell clones or common antigen presentation by dendritic cells is required for the multispecific anti-CD22 antibody to exert its desired activity. In some embodiments, the multispecific anti-CD22 antibody of the present invention is capable of redirecting CTLs to lyse the target cells in the absence of other activating signals. In some embodiments, the second antigen-binding moiety specifically binds to CD3 (e.g., specifically binds to CDR), and signaling through CD28 and/or IL-2 is not required for redirecting CTLs to lyse the target cells.

Methods for measuring the preference of the multispecific anti-CD22 antibody to simultaneously bind to two antigens (e.g., antigens on two different cells) are within the normal capabilities of a person skilled in the art. For example, when the second binding moiety specifically binds to CD3, the multispecific anti-CD22 antibody may be contacted with a mixture of CD3+/CD22− cells and CD3−/CD22$^+$ cells. The number of multispecific anti-CD22 antibody-positive single cells and the number of cells cross-linked by multispecific anti-CD22 antibodies may then be assessed by microscopy or fluorescence-activated cell sorting (FACS) as known in the art.

A multispecific anti-CD22 antibody may comprise a) an anti-CD22 binding moiety comprising i) a light chain variable region comprising LC-CDR1, LC-CDR2, and LC-CDR3 having the sequences of SEQ ID NOS: 206-208, respectively, and ii) a heavy chain variable region comprising HC-CDR1, HC-CDR2, and HC-CDR3 having the sequences of SEQ ID NOS: 209-211, respectively, and b) a second antigen-binding moiety. In another embodiment, a multispecific anti-CD22 antibody may comprise a) an anti-CD22 binding moiety comprising i) a light chain variable region comprising LC-CDR1, LC-CDR2, and LC-CDR3 having the sequences of SEQ ID NOS: 214-216, respectively, and ii) a heavy chain variable region comprising HC-CDR1, HC-CDR2, and HC-CDR3 having the sequences of SEQ ID NOS: 209, 210, and 217, respectively, and b) a second antigen-binding moiety.

In some embodiments, the multispecific anti-CD22 antibody is, for example, a diabody (Db), a single-chain diabody (scDb), a tandem scDb (Tandab), a linear dimeric scDb (LD-scDb), a circular dimeric scDb (CD-scDb), a di-diabody, a tandem scFv, a tandem di-scFv (e.g., a bispecific T cell engager), a tandem tri-scFv, a tri(a)body, a bispecific Fab2, a di-miniantibody, a tetrabody, an scFv-Fc-scFv fusion, a dual-affinity retargeting (DART) antibody, a dual variable domain (DVD) antibody, an IgG-scFab, an scFab-ds-scFv, an Fv2-Fc, an IgG-scFv fusion, a dock and lock (DNL) antibody, a knob-into-hole (KiH) antibody (bispecific IgG prepared by the KiH technology), a DuoBody (bispecific IgG prepared by the Duobody technology), a heteromultimeric antibody, or a heteroconjugate antibody. In some embodiments, the multispecific anti-CD22 antibody is a tandem scFv (e.g., a tandem di-scFv, such as a bispecific T cell engager).

Tandem scFv

The multispecific anti-CD22 antibody in some embodiments is a tandem scFv comprising a first scFv comprising an anti-CD22 binding moiety and a second scFv (also referred to herein as a "tandem scFv multispecific anti-CD22 antibody"). In some embodiments, the tandem scFv multispecific anti-CD22 antibody further comprises at least one (such as at least about any of 2, 3, 4, 5, or more) additional scFv.

In some embodiments, there is provided a tandem scFv multispecific (e.g., bispecific) anti-CD22 antibody comprising a) a first scFv that specifically binds to an extracellular region of CD22, and b) a second scFv. In some embodiments, the first scFv comprises a light chain variable region having LC-CDR1, LC-CDR2, and LC-CDR3 of the sequences of SEQ ID NOS: 206-208, respectively, and a sequence that has at least 90% (e.g., at least 92%, 94%, 96%, 98%, or 99%) identity to the sequence of SEQ ID NO: 212 and a heavy chain variable region having HC-CDR1, HC-CDR2, and HC-CDR3 of the sequences of SEQ ID NOS: 209-211, respectively, and a sequence that has at least 90% (e.g., at least 92%, 94%, 96%, 98%, or 99%) identity to the sequence of SEQ ID NO: 213, in which the light chain variable region and the heavy chain variable region are joined to each other via a linker (e.g., SRGGGGSGGGGSGGGGSLEMA (SEQ ID NO: 233)). In some embodiments, the first scFv comprises the light chain variable region sequence of SEQ ID NO: 212 and the heavy chain variable region sequence of SEQ ID NO: 213 joined to each other via a linker (e.g., SRGGGGSGGGGSGGGGSLEMA (SEQ ID NO: 233)). The first scFv may bind to an extracellular region of CD22 or a portion thereof (e.g., SEQ ID NO: 205 or a portion thereof).

In some embodiments, there is provided a tandem scFv multispecific (e.g., bispecific) anti-CD22 antibody comprising a) a first scFv that specifically binds to an extracellular region of CD22, and b) a second scFv. In some embodiments, the first scFv comprises a light chain variable region having LC-CDR1, LC-CDR2, and LC-CDR3 of the sequences of SEQ ID NOS: 214-216, respectively, and a sequence that has at least 90% (e.g., at least 92%, 94%, 96%, 98%, or 99%) identity to the sequence of SEQ ID NO: 218 and a heavy chain variable region having HC-CDR1, HC-CDR2, and HC-CDR3 of the sequences of SEQ ID NOS: 209, 210, and 217, respectively, and a sequence that has at least 90% (e.g., at least 92%, 94%, 96%, 98%, or 99%) identity to the sequence of SEQ ID NO: 219, in which the light chain variable region and the heavy chain variable region are joined to each other via a linker (e.g., SRGGGGSGGGGSGGGGSLEMA (SEQ ID NO: 233)). In some embodiments, the first scFv comprises the light chain variable region sequence of SEQ ID NO: 218 and the heavy chain variable region sequence of SEQ ID NO: 219 joined to each other via a linker (e.g., SRGGGGSGGGGSGGGGSLEMA (SEQ ID NO: 233)). The first scFv may bind to an extracellular region of CD22 or a portion thereof (e.g., SEQ ID NO: 205 or a portion thereof).

In some embodiments, the second scFv specifically binds to another antigen. In some embodiments, the second scFv specifically binds to an antigen on the surface of a cancer cell, such as a CD22-presenting cell. In some embodiments, the second scFv specifically binds to an antigen on the surface of a cell that does not express CD22. In some embodiments, the second scFv specifically binds to an antigen on the surface of a cytotoxic cell. In some embodiments, the second scFv specifically binds to an antigen on the surface of a lymphocyte, such as a T cell, an NK cell, a neutrophil, a monocyte, a macrophage, or a dendritic cell. In some embodiments, the second scFv specifically binds to an antigen on the surface of an effector T cell, such as a cytotoxic T cell. In some embodiments, the second scFv specifically binds to an antigen on the surface of an effector cell, including for example CD3γ, CD3δ, CD3ε, CD3ζ, CD28, CD16a, CD56, CD68, GDS2D, OX40, GITR, CD137, CD27, CD40L and HVEM.

In some embodiments, the first scFv is human, humanized, or semi-synthetic. In some embodiments, the second scFv is human, humanized, or semi-synthetic. In some embodiments, both the first scFv and the second scFv are human, humanized, or semi-synthetic. In some embodiments, the tandem scFv multispecific anti-CD22 antibody further comprises at least one (such as at least about any of 2, 3, 4, 5, or more) additional scFv.

In some embodiments, there is provided a tandem scFv multispecific (e.g., bispecific) anti-CD22 antibody comprising a) a first scFv that specifically binds to an extracellular region of CD22 or a portion thereof (e.g., SEQ ID NO: 205 or a portion thereof), and b) a second scFv, wherein the tandem scFv multispecific anti-CD22 antibody is a tandem di-scFv or a tandem tri-scFv. In some embodiments, the tandem scFv multispecific anti-CD22 antibody is a tandem di-scFv. In some embodiments, the tandem scFv multispecific anti-CD22 antibody is a bispecific T-cell engager.

In some embodiments, the tandem di-scFv bispecific anti-CD22 antibody binds to an extracellular region of CD22 or a portion thereof (e.g., SEQ ID NO: 205 or a portion thereof) with a Kd between about 0.1 pM to about 500 nM (such as about any of 0.1 pM, 1.0 pM, 10 pM, 50 pM, 100 pM, 500 pM, 1 nM, 10 nM, 50 nM, 100 nM, or 500 nM, including any ranges between these values). In some embodiments, the tandem di-scFv bispecific anti-CD22 antibody binds to an extracellular region of CD22 or a portion thereof (e.g., SEQ ID NO: 205 or a portion thereof) with a Kd between about 1 nM to about 500 nM (such as about any of 1, 10, 25, 50, 75, 100, 150, 200, 250, 300, 350, 400, 450, or 500 nM, including any ranges between these values).

A variety of technologies are known in the art for designing, constructing, and/or producing multispecific antibodies. Multispecific antibodies may be constructed that either utilize the full immunoglobulin framework (e.g., IgG), single chain variable fragment (scFv), or combinations thereof. Bispecific antibodies may be composed of two scFv units in tandem as described above. In the case of anti-tumor immunotherapy, bispecific antibodies that comprise two single chain variable fragments (scFvs) in tandem may be designed such that an scFv that binds a tumor antigen is linked with an scFv that engages T cells, i.e., by binding CD3 on the T cells. Thus, T cells are recruited to a tumor site to mediate killing of the tumor cells. Bispecific antibodies can be made, for example, by combining heavy chains and/or light chains that recognize different epitopes of the same or different antigen. In some embodiments, by molecular function, a bispecific binding agent binds one antigen (or epitope) on one of its two binding arms (one $V_H/V_L$ pair), and binds a different antigen (or epitope) on its second arm (a different $V_H/V_L$ pair). By this definition, a bispecific binding agent has two distinct antigen binding arms (in both specificity and CDR sequences), and is monovalent for each antigen to which it binds. In certain embodiments, a bispecific binding agent according to the present invention comprises a first and a second scFv. In some certain embodiments, a first scFv is linked to the C-terminal end of a second scFv. In some certain embodiments, a second scFv is linked to the C-terminal end of a first scFv. In some certain embodiments, scFvs are linked to each other via a linker (e.g., SRGGGGSGGGGSGGGGSLEMA (SEQ ID NO: 233)). In some certain embodiments, scFvs are linked to each other without a linker.

Chimeric Antigen Receptor (CAR) Constructs

In some embodiments, an anti-CD22 construct may be an anti-CD22 CAR. In some embodiments, the anti-CD22 CAR comprises a) an extracellular domain comprising an anti-CD22 antibody moiety that specifically binds to an extracellular region of CD22 or a portion thereof (SEQ ID NO: 205 or a portion thereof) and b) an intracellular signaling domain. A transmembrane domain may be present between the extracellular domain and the intracellular domain.

Between the extracellular domain and the transmembrane domain of the anti-CD22 CAR, or between the intracellular domain and the transmembrane domain of the anti-CD22 CAR, there may be a spacer domain. The spacer domain can be any oligo- or polypeptide that functions to link the transmembrane domain to the extracellular domain or the intracellular domain in the polypeptide chain. A spacer domain may comprise up to about 300 amino acids, including for example about 10 to about 100, or about 25 to about 50 amino acids.

The transmembrane domain may be derived either from a natural or from a synthetic source. Where the source is natural, the domain may be derived from any membrane-bound or transmembrane protein. Transmembrane regions of particular use in this invention may be derived from (i.e. comprise at least the transmembrane region(s) of) the α, β, δ, γ, or ζ chain of the T-cell receptor, CD28, CD3ε, CD3ζ, CD45, CD4, CD5, CD8, CD9, CD16, CD22, CD33, CD37, CD64, CD80, CD86, CD134, CD137, or CD154. In some embodiments, the transmembrane domain may be synthetic, in which case it may comprise predominantly hydrophobic residues such as leucine and valine. In some embodiments, a triplet of phenylalanine, tryptophan, and valine may be found at each end of a synthetic transmembrane domain. In some embodiments, a short oligo- or polypeptide linker, having a length of, for example, between about 2 and about 10 (such as about any of 2, 3, 4, 5, 6, 7, 8, 9, or 10) amino acids in length may form the linkage between the transmembrane domain and the intracellular signaling domain of the anti-CD22 CAR. In some embodiments, the linker is a glycine-serine doublet.

In some embodiments, the transmembrane domain that naturally is associated with one of the sequences in the intracellular domain of the anti-CD22 CAR is used (e.g., if an anti-CD22 CAR intracellular domain comprises a CD28 co-stimulatory sequence, the transmembrane domain of the anti-CD22 CAR is derived from the CD28 transmembrane domain). In some embodiments, the transmembrane domain can be selected or modified by amino acid substitution to avoid binding of such domains to the transmembrane domains of the same or different surface membrane proteins to minimize interactions with other members of the receptor complex.

The intracellular signaling domain of the anti-CD22 CAR is responsible for activation of at least one of the normal effector functions of the immune cell in which the anti-CD22 CAR has been placed in. Effector function of a T cell, for example, may be cytolytic activity or helper activity including the secretion of cytokines. Thus the term "intracellular signaling domain" refers to the portion of a protein which transduces the effector function signal and directs the cell to perform a specialized function. While usually the entire intracellular signaling domain can be employed, in many cases it is not necessary to use the entire chain. To the extent that a truncated portion of the intracellular signaling domain is used, such truncated portion may be used in place of the intact chain as long as it transduces the effector function signal. The term "intracellular signaling sequence" is thus meant to include any truncated portion of the intracellular signaling domain sufficient to transduce the effector function signal.

Examples of intracellular signaling domains for use in the anti-CD22 CAR of the invention include the cytoplasmic sequences of the T cell receptor (TCR) and co-receptors that act in concert to initiate signal transduction following antigen receptor engagement, as well as any derivative or variant of these sequences and any synthetic sequence that has the same functional capability.

It is known that signals generated through the TCR alone are insufficient for full activation of the T cell and that a secondary or co-stimulatory signal is also required. Thus, T cell activation can be said to be mediated by two distinct classes of intracellular signaling sequence: those that initiate antigen-dependent primary activation through the TCR (primary signaling sequences) and those that act in an antigen-independent manner to provide a secondary or co-stimulatory signal (co-stimulatory signaling sequences).

Primary signaling sequences regulate primary activation of the TCR complex either in a stimulatory way, or in an inhibitory way. Primary signaling sequences that act in a stimulatory manner may contain signaling motifs which are known as immunoreceptor tyrosine-based activation motifs or ITAMs. The anti-CD22 CAR constructs in some embodiments comprise one or more ITAMs.

Examples of ITAM containing primary signaling sequences that are of particular use in the invention include those derived from TCRζ, FcRγ, FcRβ, CD3γ, CD3δ, CD3ε, CD5, CD22, CD79a, CD79b, and CD66d.

In some embodiments, the anti-CD22 CAR comprises a primary signaling sequence derived from CD3ζ. For example, the intracellular signaling domain of the CAR can comprise the CD3ζ intracellular signaling sequence by itself or combined with any other desired intracellular signaling sequence(s) useful in the context of the anti-CD22 CAR of the invention. For example, the intracellular domain of the anti-CD22 CAR can comprise a CD3ζ intracellular signaling sequence and a co-stimulatory signaling sequence. The co-stimulatory signaling sequence can be a portion of the intracellular domain of a co-stimulatory molecule including, for example, CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, a ligand that specifically binds with CD83, and the like.

In some embodiments, the intracellular signaling domain of the anti-CD22 CAR comprises the intracellular signaling sequence of CD3 and the intracellular signaling sequence of CD28. In some embodiments, the intracellular signaling domain of the anti-CD22 CAR comprises the intracellular signaling sequence of CD3 and the intracellular signaling sequence of 4-1BB. In some embodiments, the intracellular signaling domain of the anti-CD22 CAR comprises the intracellular signaling sequence of CD3 and the intracellular signaling sequences of CD28 and 4-1BB.

Thus, for example, in some embodiments, there is provided an anti-CD22 CAR comprising a) an extracellular domain comprising an anti-CD22 antibody moiety that specifically binds to an extracellular region of CD22 or a portion thereof (e.g., SEQ ID NO: 205 or a portion thereof), b) a transmembrane domain, and c) an intracellular signaling domain. In some embodiments, the intracellular signaling domain is capable of activating an immune cell. In some embodiments, the intracellular signaling domain comprises a primary signaling sequence and a co-stimulatory signaling sequence. In some embodiments, the primary signaling sequence comprises a CD3 intracellular signaling sequence. In some embodiments, the co-stimulatory signaling sequence comprises a CD28 and/or 4-1BB intracellular signaling sequence. In some embodiments, the intracellular domain comprises a CD3 intracellular signaling sequence and a CD28 and/or 4-1BB intracellular signaling sequence.

In some embodiments, the anti-CD22 CAR comprises an anti-CD22 antibody moiety comprising i) a light chain variable region comprising LC-CDR1, LC-CDR2, and LC-CDR3 having the sequences of SEQ ID NOS: 206-208, respectively, and ii) a heavy chain variable region comprising HC-CDR1, HC-CDR2, and HC-CDR3 having the sequences of SEQ ID NOS: 209-211, respectively. In other embodiments, the anti-CD22 CAR comprises an anti-CD22 antibody moiety comprising i) a light chain variable region having LC-CDR1, LC-CDR2, and LC-CDR3 of the sequences of SEQ ID NOS: 206-208, respectively, and a sequence that has at least 90% (e.g., at least 92%, 94%, 96%, 98%, or 99%) identity to the sequence of SEQ ID NO: 212, and ii) a heavy chain variable region having HC-CDR1, HC-CDR2, and HC-CDR3 of the sequences of SEQ ID NOS: 209-211, respectively, and a sequence that has at least 90% (e.g., at least 92%, 94%, 96%, 98%, or 99%) identity to the sequence of SEQ ID NO: 213, in which the light chain variable region and the heavy chain variable region are joined to each other via a linker.

In some embodiments, the anti-CD22 CAR comprises an anti-CD22 antibody moiety comprising i) a light chain variable region comprising LC-CDR1, LC-CDR2, and LC-CDR3 having the sequences of SEQ ID NOS: 214-216, respectively, and ii) a heavy chain variable region comprising HC-CDR1, HC-CDR2, and HC-CDR3 having the sequences of SEQ ID NOS: 209, 210, and 217, respectively. In other embodiments, the anti-CD22 CAR comprises an anti-CD22 antibody moiety comprising i) a light chain variable region having LC-CDR1, LC-CDR2, and LC-CDR3 of the sequences of SEQ ID NOS: 214-216, respectively, and a sequence that has at least 90% (e.g., at least 92%, 94%, 96%, 98%, or 99%) identity to the sequence of SEQ ID NO: 218, and ii) a heavy chain variable region having HC-CDR1, HC-CDR2, and HC-CDR3 of the sequences of SEQ ID NOS: 209, 210, and 217, respectively, and a sequence that has at least 90% (e.g., at least 92%, 94%, 96%, 98%, or 99%) identity to the sequence of SEQ ID NO: 219, in which the light chain variable region and the heavy chain variable region are joined to each other via a linker.

Chimeric Antibody-T Cell Receptor (caTCR) Constructs

In some embodiments, the anti-CD22 construct is a chimeric antibody-T cell receptor construct (referred to herein as "caTCR"), and the anti-CD22 chimeric antibody-T cell receptor is an anti-CD22 caTCR. In some embodiments, the anti-CD22 caTCR comprises a) an extracellular domain comprising an anti-CD22 antibody moiety that specifically binds to an extracellular region of CD22 or a portion thereof (e.g., SEQ ID NO: 205 or a portion thereof) and b) a T cell receptor module (TCRM) capable of recruiting at least one TCR-associated signaling module.

In some embodiments, the anti-CD22 caTCR comprises a first polypeptide chain and a second polypeptide chain. In some embodiments, the first and second polypeptide chains are linked, such as by a covalent linkage (e.g., peptide or other chemical linkage) or non-covalent linkage. In some embodiments, the anti-CD22 caTCR is a heterodimer comprising the first polypeptide chain and the second polypeptide chain. In some embodiments, the first polypeptide chain and the second polypeptide chain are linked by at least one disulfide bond. The specificity of the anti-CD22 caTCR derives from an antibody moiety that confers binding specificity to an extracellular region of CD22 or a portion thereof (e.g., SEQ ID NO: 205 or a portion thereof). In some embodiments, the antibody moiety is a Fab-like antigen-binding module. In some embodiments, the antibody moiety is an Fv-like antigen-binding module. In some embodiments, the antibody moiety is an scFv. The capability of the anti-CD22 caTCR to recruit a TCR-associated signaling module derives from a T cell receptor module (TCRM). In some embodiments, the TCRM comprises the transmembrane module of a TCR (such as an αβTCR or a γδTCR). In some embodiments, the TCRM further comprises one or both of the connecting peptides or fragments thereof of a TCR. In some embodiments, the anti-CD22 caTCR further comprises at least one intracellular domain. In some embodiments, one or more of the at least one intracellular domain of the anti-CD22 caTCR comprises a sequence from the intracellular domain of a TCR. In some embodiments, the antibody moiety is contained in an extracellular domain of the anti-CD22 caTCR. In some embodiments, the anti-CD22 caTCR further comprises one or more peptide linkers between the antibody moiety and the TCRM to optimize the length of the extracellular domain.

In some embodiments, the antibody moiety is a Fab-like antigen-binding module that specifically binds to an extracellular region of CD22 or a portion thereof (e.g., SEQ ID NO: 205 or a portion thereof), comprising a) a first polypeptide chain comprising a first antigen-binding region comprising a $V_H$ antibody domain and a $C_H1$ antibody domain and b) a second polypeptide chain comprising a second antigen-binding region comprising a $V_L$ antibody domain and a $C_L$ antibody domain. In some embodiments, the first antigen-binding region comprises the $V_H$ antibody domain amino-terminal to the $C_H1$ antibody domain and/or the second antigen-binding region comprises the $V_L$ antibody domain amino-terminal to the $C_L$ antibody domain. In some embodiments, there is a peptide linker between the $V_L$ and $C_L$ antibody domains and/or a peptide linker between the $V_H$ and $C_H1$ antibody domains. In some embodiments, all of the $V_L$ antibody domain and $V_H$ antibody domain CDRs are derived from the same antibody moiety. In some embodiments, the $V_L$ antibody domain and the $V_H$ antibody domain comprise antibody CDRs derived from more than one antibody moiety. In some embodiments, the first and second polypeptide chains are linked, such as by a covalent linkage (e.g., peptide or other chemical linkage) or non-covalent linkage. In some embodiments, the first and second antigen-binding regions are linked by a disulfide bond. In some embodiments, the first and second antigen-binding regions are linked by a disulfide bond between a residue in the $C_H1$ domain and a residue in the $C_L$ domain. In some embodiments, the $C_H1$ domain is derived from an IgG (e.g, IgG1, IgG2, IgG3, or IgG4) heavy chain, optionally human. In some embodiments, the $C_H1$ domain is a variant comprising one or more modifications (e.g., amino acid substitutions, insertions, and/or deletions) compared to the sequence from which it is derived. In some embodiments, the CL domain is derived from a light chain of the kappa or lambda isotype. In some embodiments, the $C_L$ domain is a variant comprising one or more modifications (e.g., amino acid substitutions, insertions, and/or deletions) compared to the sequence from which it is derived. In some embodiments, the $C_H1$ and/or $C_L$ domains comprise one or more modifications that do not substantially alter their binding affinities for one another. In some embodiments, the $C_H1$ and/or $C_L$ domains comprise one or more modifications that increase their binding affinities for one another and/or introduce a non-naturally occurring disulfide bond. In some embodiments, the Fab-like antigen-binding module is human, humanized, chimeric, semi-synthetic, or fully synthetic.

In some embodiments, the antibody moiety is a Fab-like antigen-binding module that specifically binds to an extracellular region of CD22 or a portion thereof (e.g., SEQ ID NO: 205 or a portion thereof), comprising a) a first polypeptide chain comprising a first antigen-binding region comprising a $V_L$ antibody domain and a $C_H1$ antibody domain and b) a second polypeptide chain comprising a second antigen-binding region comprising a $V_H$ antibody domain and a $C_L$ antibody domain. In some embodiments, the first antigen-binding region comprises the $V_L$ antibody domain amino-terminal to the $C_H1$ antibody domain and/or the second antigen-binding region comprises the $V_H$ antibody domain amino-terminal to the $C_L$ antibody domain. In some embodiments, there is a peptide linker between the $V_H$ and $C_L$ antibody domains and/or a peptide linker between the $V_L$ and $C_H1$ antibody domains. In some embodiments, all of the $V_L$ antibody domain and $V_H$ antibody domain CDRs are derived from the same antibody moiety. In some embodiments, the $V_L$ antibody domain and the $V_H$ antibody domain comprise antibody CDRs derived from more than one antibody moiety. In some embodiments, the first and second polypeptide chains are linked, such as by a covalent linkage (e.g., peptide or other chemical linkage) or non-covalent linkage. In some embodiments, the first and second antigen-binding regions are linked by a disulfide bond. In some embodiments, the first and second antigen-binding regions are linked by a disulfide bond between a residue in the $C_H1$ domain and a residue in the $C_L$ domain. In some embodiments, the $C_H1$ domain is derived from an IgG (e.g, IgG1, IgG2, IgG3, or IgG4) heavy chain, optionally human. In some embodiments, the $C_H1$ domain is a variant comprising one or more modifications (e.g., amino acid substitutions, insertions, and/or deletions) compared to the sequence from which it is derived. In some embodiments, the CL domain is derived from a light chain of the kappa or lambda isotype. In some embodiments, the $C_L$ domain is a variant comprising one or more modifications (e.g., amino acid substitutions, insertions, and/or deletions) compared to the sequence from which it is derived. In some embodiments, the $C_H1$ and/or $C_L$ domains comprise one or more modifications that do not substantially alter their binding affinities for one another. In some embodiments, the $C_H1$ and/or $C_L$ domains comprise one or more modifications that increase their binding affinities for one another and/or introduce a non-naturally occurring disulfide bond. In some embodiments, the Fab-like antigen-binding module is human, humanized, chimeric, semi-synthetic, or fully synthetic.

In some embodiments, the antibody moiety is an Fv-like antigen-binding module that specifically binds to an extracellular region of CD22 or a portion thereof (e.g., SEQ ID NO: 205 or a portion thereof), comprising a) a first polypeptide chain comprising a first antigen-binding region comprising a $V_H$ antibody domain and optionally a first TCR constant domain from a T cell receptor subunit; and b) a second polypeptide chain comprising a second antigen-binding region comprising a $V_L$ antibody domain and optionally a second TCR constant domain from a T cell receptor subunit. In some embodiments, the first antigen-binding region comprises the $V_H$ antibody domain amino-terminal to the first TCR constant domain and/or the second antigen-binding region comprises the $V_L$ antibody domain amino-terminal to the second TCR constant domain. In some embodiments, there is a peptide linker between the $V_L$ antibody domain and the first TCR constant domain and/or a peptide linker between the $V_H$ antibody domain and the second TCR constant domain. In some embodiments, all of the $V_L$ antibody domain and $V_H$ antibody domain CDRs are derived from the same antibody moiety. In some embodiments, the $V_L$ antibody domain and the $V_H$ antibody domain comprise antibody CDRs derived from more than one antibody moiety. In some embodiments, the first and second polypeptide chains are linked, such as by a covalent linkage (e.g., peptide or other chemical linkage) or non-covalent linkage. In some embodiments, the first and second antigen-binding regions are linked by a disulfide bond. In some embodiments, the first and second antigen-binding regions are linked by a disulfide bond between a residue in the first TCR constant domain and a residue in the second TCR constant domain. In some embodiments, the first TCR constant domain is derived from a TCR α subunit, optionally human, and/or the second TCR constant domain is derived from a TCR β subunit, optionally human. In some embodiments, the first TCR constant domain is derived from a TCR δ subunit, optionally human, and/or the second TCR constant domain is derived from a TCR γ subunit, optionally human. In some embodiments, the first and/or second TCR constant domain is a variant comprising one or more modifications (e.g., amino acid substitutions, insertions, and/or deletions) compared to the sequence from which it is derived. In some embodiments, the first and/or second TCR constant domains comprise one or more modifications that do not substantially alter their binding affinities for one another. In some embodiments, the first and/or second TCR constant domains comprise one or more modifications that increase their binding affinities for one another and/or introduce a non-naturally occurring disulfide bond. In some embodiments, the Fv-like antigen-binding module is human, humanized, chimeric, semi-synthetic, or fully synthetic.

In some embodiments, the antibody moiety is an scFv that specifically binds to an extracellular region of CD22 or a portion thereof (e.g., SEQ ID NO: 205 or a portion thereof), comprising a) a polypeptide chain comprising a $V_H$ antibody domain and a $V_L$ antibody domain. In some embodiments, the scFv comprises the $V_H$ antibody domain amino-terminal to the $V_L$ antibody domain. In some embodiments, the scFv comprises the $V_L$ antibody domain amino-terminal to the $V_H$ antibody domain. In some embodiments, there is a peptide linker between the $V_L$ antibody domain and the $V_H$ antibody domain. In some embodiments, all of the $V_L$ antibody domain and $V_H$ antibody domain CDRs are derived from the same antibody moiety. In some embodiments, the $V_L$ antibody domain and the $V_H$ antibody domain comprise antibody CDRs derived from more than one antibody moiety. In some embodiments, the scFv is human, humanized, chimeric, semi-synthetic, or fully synthetic.

In some embodiments, the TCRM comprises a) a first polypeptide chain comprising a first T cell receptor domain (TCRD) comprising a first transmembrane domain and b) a second polypeptide chain comprising a second TCRD comprising a second transmembrane domain. In some embodiments, the first transmembrane domain is the transmembrane domain of a first TCR subunit and/or the second transmembrane domain is the transmembrane domain of a second TCR subunit. In some embodiments, the first TCR subunit is a TCR α chain (e.g., GenBank Accession No: CCI73895), and the second TCR subunit is a TCR β chain (e.g., GenBank Accession No: CCI73893). In some embodiments, the first TCR subunit is a TCR β chain, and the second TCR subunit is a TCR α chain. In some embodiments, the first TCR subunit is a TCR γ chain (e.g., GenBank Accession No: AGE91788), and the second TCR subunit is a TCR δ chain (e.g., GenBank Accession No: AAQ57272). In some embodiments, the first TCR subunit is a TCR δ chain, and the second TCR subunit is a TCR γ chain. In some embodiments, the first TCRD further comprises a first connecting peptide amino-terminal to the transmembrane domain and/or the second TCRD further comprises a second connecting peptide amino-terminal to the transmembrane domain. In some embodiments, the first connecting peptide comprises all or a portion of the connecting peptide of the first TCR subunit and/or the second connecting peptide comprises all or a portion of the connecting peptide of the second TCR subunit. In some embodiments, the first TCRD further comprises a first TCR intracellular domain carboxy-terminal to the first transmembrane domain and/or the second TCRD further comprises a second TCR intracellular domain carboxy-terminal to the second transmembrane domain. In some embodiments, the first TCR intracellular domain comprises all or a portion of the intracellular domain of the first TCR subunit and/or the second TCR intracellular domain comprises all or a portion of the intracellular domain of the second TCR subunit. In some embodiments, the first TCRD is a fragment of the first TCR subunit and/or the second TCRD is a fragment of the second TCR chain. In some embodiments, the first and second polypeptide chains are linked, such as by a covalent linkage (e.g., peptide or other chemical linkage) or non-covalent linkage. In some embodiments, the first and second TCRDs are linked by a disulfide bond. In some embodiments, the first and second TCRDs are linked by a disulfide bond between a residue in the first connecting peptide and a residue in the second connecting peptide. In some embodiments, the TCRM is capable of recruiting at least one TCR-associated signaling module selected from the group consisting of CD3δε, CD3γε, and CD3ζ. In some embodiments, the TCRM is capable of recruiting each of CD3δε, CD3γε, and CD3ζ to form an octameric anti-CD22 caTCR-CD3 complex (i.e., promotes anti-CD22 caTCR-CD3 complex formation).

In some embodiments, the anti-CD22 caTCR is a molecule comprising a fusion of the antibody moiety (which specifically binds to an extracellular region of CD22 or a portion thereof (e.g., SEQ ID NO: 205 or a portion thereof)) to the TCRM. In some embodiments, the anti-CD22 caTCR comprises a fusion of the first polypeptide chain of the Fab-like or Fv-like antigen-binding module amino-terminal to the first polypeptide chain of the TCRM, thereby forming a first polypeptide chain of the anti-CD22 caTCR, and a fusion of the second polypeptide chain of the Fab-like or Fv-like antigen-binding module amino-terminal to the second polypeptide chain of the TCRM, thereby forming a second polypeptide chain of the anti-CD22 caTCR. In some embodiments, the anti-CD22 caTCR comprises a fusion of the scFv amino-terminal to the first or second polypeptide chain of the TCRM. In some embodiments, the anti-CD22 caTCR further comprises a peptide linker between the first polypeptide chain of the Fab-like or Fv-like antigen-binding module and the first polypeptide chain of the TCRM and/or a peptide linker between the second polypeptide chain of the Fab-like or Fv-like antigen-binding module and the second polypeptide chain of the TCRM. In some embodiments, the anti-CD22 caTCR further comprises a peptide linker between the scFv and the first or second polypeptide chain of the TCRM. In some embodiments, the peptide linker is between about 5 to about 70 (such as about any of 5, 10, 15, 20, 25, 30, 35, 40, 45, 50, 55, 60, 65, or 70, including any ranges between these values) amino acids in length. In some embodiments, the first polypeptide chain of the anti-CD22 caTCR further comprises an amino-terminal first signal peptide and/or the second polypeptide chain of the anti-CD22 caTCR further comprises an amino-terminal second signal peptide. In some embodiments, the first polypeptide chain of the anti-CD22 caTCR further comprises a first accessory intracellular domain carboxy-terminal to the first transmembrane domain and/or the second polypeptide chain of the anti-CD22 caTCR further comprises a second accessory intracellular domain carboxy-terminal to the second transmembrane domain. In some embodiments, the first and/or second accessory intracellular domains comprise a TCR costimulatory domain. In some embodiments, the first and second polypeptide chains of the anti-CD22 caTCR are linked, such as by a covalent linkage (e.g., peptide or other chemical linkage) or non-covalent linkage. In some embodiments, the anti-CD22 caTCR is a heterodimer.

Thus, for example, in some embodiments, there is provided an anti-CD22 caTCR comprising a) an extracellular domain comprising an anti-CD22 antibody moiety that specifically binds to an extracellular region of CD22 or a portion thereof (e.g., SEQ ID NO: 205 or a portion thereof), and b) a T cell receptor module (TCRM) capable of recruiting at least one TCR-associated signaling module. In some embodiments, the antibody moiety is a Fab-like antigen-binding module. In some embodiments, the antibody moiety is an Fv-like antigen-binding module. In some embodiments, the antibody moiety is an scFv.

In some embodiments, there is provided an anti-CD22 caTCR comprising a) an extracellular domain comprising an anti-CD22 antibody moiety that specifically binds to an extracellular region of CD22 or a portion thereof (e.g., SEQ ID NO: 205 or a portion thereof) comprising i) a light chain variable region comprising LC-CDR1, LC-CDR2, and LC-CDR3 having the sequences of SEQ ID NOS: 206-208, respectively, and ii) a heavy chain variable region comprising HC-CDR1, HC-CDR2, and HC-CDR3 having the sequences of SEQ ID NOS: 209-211, respectively, and b) a T cell receptor module (TCRM) capable of recruiting at least one TCR-associated signaling module. In some embodiments, there is provided an anti-CD22 caTCR comprising a) an extracellular domain comprising an anti-CD22 antibody moiety that specifically binds to an extracellular region of CD22 or a portion thereof (e.g., SEQ ID NO: 205 or a portion thereof) comprising i) a light chain variable region having LC-CDR1, LC-CDR2, and LC-CDR3 of the sequences of SEQ ID NOS: 206-208, respectively, and a sequence that has at least 90% (e.g., at least 92%, 94%, 96%, 98%, or 99%) identity to the sequence of SEQ ID NO: 212, and ii) a heavy chain variable region having HC-CDR1, HC-CDR2, and HC-CDR3 of the sequences of SEQ ID NOS: 209-211, respectively, and a sequence that has at least 90% (e.g., at least 92%, 94%, 96%, 98%, or 99%) identity to the sequence of SEQ ID NO: 213, in which the light chain variable region and the heavy chain variable region are joined to each other via a linker; and b) a T cell receptor module (TCRM) capable of recruiting at least one TCR-associated signaling module. In some embodiments, the antibody moiety is a Fab-like antigen-binding module. In some embodiments, the antibody moiety is an Fv-like antigen-binding module. In some embodiments, the antibody moiety is an scFv.

In some embodiments, there is provided an anti-CD22 caTCR comprising a) an extracellular domain comprising an anti-CD22 antibody moiety that specifically binds to an extracellular region of CD22 or a portion thereof (e.g., SEQ ID NO: 205 or a portion thereof) comprising i) a light chain variable region comprising LC-CDR1, LC-CDR2, and LC-CDR3 having the sequences of SEQ ID NOS: 214-216, respectively, and ii) a heavy chain variable region comprising HC-CDR1, HC-CDR2, and HC-CDR3 having the sequences of SEQ ID NOS: 209, 210, and 217, respectively, and b) a T cell receptor module (TCRM) capable of recruiting at least one TCR-associated signaling module. In some embodiments, there is provided an anti-CD22 caTCR comprising a) an extracellular domain comprising an anti-CD22 antibody moiety that specifically binds to an extracellular region of CD22 or a portion thereof (e.g., SEQ ID NO: 205 or a portion thereof) comprising i) a light chain variable region having LC-CDR1, LC-CDR2, and LC-CDR3 of the sequences of SEQ ID NOS: 214-216, respectively, and a sequence that has at least 90% (e.g., at least 92%, 94%, 96%, 98%, or 99%) identity to the sequence of SEQ ID NO: 218, and ii) a heavy chain variable region having HC-CDR1, HC-CDR2, and HC-CDR3 of the sequences of SEQ ID NOS: 209, 210, and 217, respectively, and a sequence that has at least 90% (e.g., at least 92%, 94%, 96%, 98%, or 99%) identity to the sequence of SEQ ID NO: 219, in which the light chain variable region and the heavy chain variable region are joined to each other via a linker; and b) a T cell receptor module (TCRM) capable of recruiting at least one TCR-associated signaling module. In some embodiments, the antibody moiety is a Fab-like antigen-binding module. In some embodiments, the antibody moiety is an Fv-like antigen-binding module. In some embodiments, the antibody moiety is an scFv.

In some embodiments, the anti-CD22 construct is a chimeric signaling receptor (CSR). For example, the CSR may comprise: (a) an anti-CD22 antibody moiety described herein (e.g., an anti-CD22 antibody moiety comprising a light chain variable region having the sequence of SEQ ID NO: 218 and a heavy chain variable region having the sequence of SEQ ID NO: 219; or an anti-CD22 antibody moiety comprising a light chain variable region having the sequence of SEQ ID NO: 212 and a heavy chain variable region having the sequence of SEQ ID NO: 213); (b) a transmembrane module; and (c) a co-stimulatory immune cell signaling module that is capable of providing a co-stimulatory signal to the immune cell, in which the CSR lacks a functional primary immune cell signaling domain. In some embodiments, the CSR is used in combination with a caTCR or CAR (e.g., a caTCR or CAR that specifically targets CD22).

Chimeric Co-Stimulatory Receptor (CSR) Constructs

The ligand-specific chimeric co-stimulatory receptor (CSR) described herein specifically binds to a target ligand (such as a cell surface antigen or a peptide/MHC complex) and is capable of stimulating an immune cell on the surface of which it is functionally expressed upon target ligand binding. The CSR comprises a ligand-binding module that provides the ligand-binding specificity, a transmembrane module, and a co-stimulatory immune cell signaling module that allows for stimulating the immune cell. The CSR lacks a functional primary immune cell signaling sequence. In some embodiments, the CSR lacks any primary immune cell signaling sequence. In some embodiments, the CSR comprises a single polypeptide chain comprising the ligand-binding module, transmembrane module, and co-stimulatory signaling module. In some embodiments, the CSR comprises a first polypeptide chain and a second polypeptide chain, wherein the first and second polypeptide chains together form the ligand-binding module, transmembrane module, and co-stimulatory signaling module. In some embodiments, the first and second polypeptide chains are separate polypeptide chains, and the CSR is a multimer, such as a dimer. In some embodiments, the first and second polypeptide chains are covalently linked, such as by a peptide linkage, or by another chemical linkage, such as a disulfide linkage. In some embodiments, the first polypeptide chain and the second polypeptide chain are linked by at least one disulfide bond. In some embodiments, the expression of the CSR in the caTCR plus CSR immune cell is inducible. In some embodiments, the expression of the CSR in the caTCR plus CSR immune cell is inducible upon signaling through the caTCR. Further description of CSR may be found in U.S. Application No. 62/490,578, filed Apr. 26, 2017, which is incorporated by reference herein in its entirety.

Examples of co-stimulatory immune cell signaling domains for use in the CSRs of the invention include the cytoplasmic sequences of co-receptors of the T cell receptor (TCR), which can act in concert with a caTCR to initiate signal transduction following caTCR engagement, as well as any derivative or variant of these sequences and any synthetic sequence that has the same functional capability.

It is known that signals generated through the TCR alone are insufficient for full activation of the T cell and that a secondary or co-stimulatory signal is also required. Thus, T cell activation can be said to be mediated by two distinct classes of intracellular signaling sequence: those that initiate antigen-dependent primary activation through the TCR (referred to herein as "primary T cell signaling sequences") and those that act in an antigen-independent manner to provide a secondary or co-stimulatory signal (referred to herein as "co-stimulatory T cell signaling sequences").

Primary immune cell signaling sequences that act in a stimulatory manner may contain signaling motifs which are known as immunoreceptor tyrosine-based activation motifs or ITAMs. Examples of ITAM-containing primary immune cell signaling sequences include those derived from TCRζ, FcRγ, FcRβ, CD3γ, CD3δ, CD3ε, CD5, CD22, CD79a, CD79b, and CD66d. A "functional" primary immune cell signaling sequence is a sequence that is capable of transducing an immune cell activation signal when operably coupled to an appropriate receptor. "Non-functional" primary immune cell signaling sequences, which may comprises fragments or variants of primary immune cell signaling sequences, are unable to transduce an immune cell activation signal. The CSRs described herein lack a functional primary immune cell signaling sequence, such as a functional signaling sequence comprising an ITAM. In some embodiments, the CSRs lack any primary immune cell signaling sequence.

The co-stimulatory immune cell signaling sequence can be a portion of the intracellular domain of a co-stimulatory molecule including, for example, CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, a ligand that specifically binds with CD83, and the like.

In some embodiments, the target ligand is a cell surface antigen. In some embodiments, the target ligand is a peptide/MHC complex. In some embodiments, the target ligand is the same as the target antigen of a caTCR expressed in the same immune cell. In some embodiments, the target ligand is different than the target antigen of a caTCR expressed in the same immune cell. In some embodiments, the target ligand is a molecule presented on the surface of a cell presenting the target antigen. For example, in some embodiments, the target antigen of the caTCR is a cancer-associated antigen presented on a cancer cell, and the target ligand is a ubiquitous molecule expressed on the surface of the cancer cell, such as an integrin. In some embodiments, the target ligand is a disease-associated ligand. In some embodiments, the target ligand is a cancer-associated ligand. In some embodiments, the cancer-associated ligand is, for example, CD19, CD20, CD47, IL4, GPC-3, ROR1, ROR2, BCMA, GPRC5D, or FCRL5. In some embodiments, the cancer-associated ligand is a peptide/MHC complex comprising a peptide derived from a protein including WT-1, AFP, HPV16-E7, NY-ESO-1, PRAME, EBV-LMP2A, and PSA. In some embodiments, the target ligand is a virus-associated ligand. In some embodiments, the target ligand is an immune checkpoint molecule. In some embodiments, the immune checkpoint molecule includes PD-L1, PD-L2, CD80, CD86, ICOSL, B7-H3, B7-H4, HVEM, 4-1BBL, OX40L, CD70, CD40, and GAL9. In some embodiments, the target ligand is an apoptotic molecule. In some embodiments, the apoptotic molecule includes FasL, FasR, TNFR1, and TNFR2.

In some embodiments, the ligand-binding module is an antibody moiety. In some embodiments, the antibody moiety is a Fab, a Fab', a (Fab')2, an Fv, or a single chain Fv (scFv). In some embodiments, the antibody moiety specifically binds a cell surface antigen, e.g., CD22. In some embodiments, the antibody moiety comprises the CDRs or variables domains ($V_H$ and/or $V_L$ domains) of an antibody moiety specific for CD22 (e.g., $V_H$ domain comprising, consisting essentially of, or consisting of the amino acid sequence of SEQ ID NO: 219 and/or $V_L$ domain comprising, consisting essentially of, or consisting of the amino acid sequence of SEQ ID NO: 218, or CDRs contained therein). In some embodiments, the antibody moiety comprises the CDRs or variables domains ($V_H$ and/or $V_L$ domains) of an antibody moiety specific for CD22 (e.g., $V_H$ domain comprising, consisting essentially of, or consisting of the amino acid sequence of SEQ ID NO: 213 and/or $V_L$ domain comprising, consisting essentially of, or consisting of the amino acid sequence of SEQ ID NO: 212, or CDRs contained therein).

In some embodiments, the transmembrane module comprises one or more transmembrane domains derived from, for example, CD28, CD3ε, CD3ζ, CD45, CD4, CD5, CD8, CD9, CD16, CD22, CD33, CD37, CD64, CD80, CD86, CD134, CD137, or CD154.

In some embodiments, the co-stimulatory signaling module comprises, consists essentially of, or consists of all or a portion of the intracellular domain of an immune cell co-stimulatory molecule including, for example, CD27, CD28, 4-1BB (CD137), OX40, CD30, CD40, ICOS, lymphocyte function-associated antigen-1 (LFA-1), CD2, CD7, LIGHT, NKG2C, B7-H3, a ligand that specifically binds with CD83, and the like.

In some embodiments, the CSR further comprises a spacer module between any of the ligand-binding module, the transmembrane module, and the co-stimulatory signaling module. In some embodiments, the spacer module comprises one or more peptide linkers connecting two CSR modules. In some embodiments, the spacer module comprises one or more peptide linkers between about 5 to about 70 (such as about any of 5, 10, 15, 20, 25, 30, 35, 40, 45, 50, 55, 60, 65, or 70, including any ranges between these values) amino acids in length.

In some embodiments, the ligand-binding module (such as an antibody moiety) specifically binds to a target antigen with a) an affinity that is at least about 10 (including for example at least about any of 10, 20, 30, 40, 50, 75, 100, 200, 300, 400, 500, 750, 1000 or more) times its binding affinity for other molecules; or b) a Kd no more than about 1/10 (such as no more than about any of 1/10, 1/20, 1/30, 1/40, 1/50, 1/75, 1/100, 1/200, 1/300, 1/400, 1/500, 1/750, 1/1000 or less) times its Kd for binding to other molecules. Binding affinity can be determined by methods known in the art, such as ELISA, fluorescence activated cell sorting (FACS) analysis, or radioimmunoprecipitation assay (RIA). Kd can be determined by methods known in the art, such as surface plasmon resonance (SPR) assay utilizing, for example, Biacore instruments, or kinetic exclusion assay (KinExA) utilizing, for example, Sapidyne instruments.

In some embodiments, the CSR described herein specifically binds to a target ligand (e.g., CD22), comprising a) a target ligand-binding domain (LBD); b) a transmembrane domain; and c) and a co-stimulatory signaling domain, wherein the CSR is capable of stimulating an immune cell on the surface of which it is functionally expressed upon target ligand binding. In some embodiments, the target ligand is a cell surface antigen. In some embodiments, the target ligand is a peptide/MHC complex. In some embodiments, the target ligand is the same as the target antigen of a caTCR expressed in the same immune cell. In some embodiments, the target ligand is different from the target antigen of a caTCR expressed in the same immune cell. In some embodiments, the target ligand is a disease-associated ligand. In some embodiments, the target ligand is a cancer-associated ligand. In some embodiments, the cancer-associated ligand is, for example, CD19, CD20, CD47, IL4, GPC-3, ROR1, ROR2, BCMA, GPRCSD, or FCRL5. In some embodiments, the cancer-associated ligand is a peptide/MHC complex comprising a peptide derived from a protein including WT-1, AFP, HPV16-E7, NY-ESO-1, PRAME, EBV-LMP2A, and PSA. In some embodiments, the target ligand is a virus-associated ligand. In some embodiments, the target ligand is an immune checkpoint molecule. In some embodiments, the immune checkpoint molecule includes PD-L1, PD-L2, CD80, CD86, ICOSL, B7-H3, B7-H4, HVEM, 4-1BBL, OX40L, CD70, CD40, and GAL9. In some embodiments, the target ligand is an apoptotic molecule. In some embodiments, the apoptotic molecule includes FasL, FasR, TNFR1, and TNFR2. In some embodiments, the ligand-binding domain is an antibody moiety. In some embodiments, the antibody moiety is a Fab, a Fab', a (Fab')2, an Fv, or a single chain Fv (scFv). In some embodiments, the ligand-binding domain is (or is derived from) all or a portion of the extracellular domain of a receptor for the target ligand. In some embodiments, the receptor includes, for example, FasR, TNFR1, TNFR2, PD-1, CD28, CTLA-4, ICOS, BTLA, KIR, LAG-3, 4-1BB, OX40, CD27, and TIM-3. In some embodiments, the transmembrane domain comprises a transmembrane domain derived from a transmembrane protein including, for example, CD28, CD3ε, CD3ζ, CD45, CD4, CD5, CD8, CD9, CD16, CD22, CD33, CD37, CD64, CD80, CD86, CD134, CD137, or CD154. In some embodiments, the CSR comprises a fragment of a transmembrane protein (fTMP), wherein the fTMP comprises the CSR transmembrane domain. In some embodiments, the co-stimulatory signaling domain comprises, consists essentially of, or consists of all or a portion of the intracellular domain of an immune cell co-stimulatory molecule including, for example, CD27, CD28, 4-1BB (CD137), OX40, CD30, CD40, ICOS, lymphocyte function-associated antigen-1 (LFA-1), CD2, CD7, LIGHT, NKG2C, B7-H3, a ligand that specifically binds with CD83, and the like. In some embodiments, the CSR comprises a fragment of an immune cell co-stimulatory molecule (fCSM), wherein the fCSM comprises the CSR transmembrane domain and CSR co-stimulatory signaling domain. In some embodiments, the CSR further comprises a spacer domain between any of the ligand-binding domain, the transmembrane domain, and the co-stimulatory signaling domain. In some embodiments, the spacer domain comprises a peptide linker connecting two CSR domains.

In some embodiments, the CSR described herein specifically binds to a target ligand (e.g., CD22), comprising a) a target ligand-binding domain; b) a transmembrane domain;

and c) and a co-stimulatory signaling domain, wherein the target ligand is a cell surface antigen, and wherein the CSR is capable of stimulating an immune cell on the surface of which it is functionally expressed upon target ligand binding. In some embodiments, the target ligand is the same as the target antigen of a caTCR expressed in the same immune cell. In some embodiments, the target ligand is different from the target antigen of a caTCR expressed in the same immune cell. In some embodiments, the target ligand is a disease-associated ligand. In some embodiments, the target ligand is a cancer-associated ligand. In some embodiments, the cancer-associated ligand is, for example, CD19, CD20, CD47, IL4, GPC-3, ROR1, ROR2, BCMA, GPRC5D, or FCRL5. In some embodiments, the target ligand is a virus-associated ligand. In some embodiments, the target ligand is an immune checkpoint molecule. In some embodiments, the immune checkpoint molecule includes PD-L1, PD-L2, CD80, CD86, ICOSL, B7-H3, B7-H4, HVEM, 4-1BBL, OX40L, CD70, CD40, and GAL9. In some embodiments, the target ligand is an apoptotic molecule. In some embodiments, the apoptotic molecule includes FasL, FasR, TNFR1, and TNFR2. In some embodiments, the ligand-binding domain is an antibody moiety. In some embodiments, the antibody moiety is a Fab, a Fab', a (Fab')2, an Fv, or a single chain Fv (scFv). In some embodiments, the ligand-binding domain is (or is derived from) all or a portion of the extracellular domain of a receptor for the target ligand. In some embodiments, the receptor includes, for example, FasR, TNFR1, TNFR2, PD-1, CD28, CTLA-4, ICOS, BTLA, KIR, LAG-3, 4-1BB, OX40, CD27, and TIM-3. In some embodiments, the transmembrane domain comprises a transmembrane domain derived from a transmembrane protein including, for example, CD28, CD3ε, CD3ζ, CD45, CD4, CD5, CD8, CD9, CD16, CD22, CD33, CD37, CD64, CD80, CD86, CD134, CD137, or CD154. In some embodiments, the CSR comprises a fragment of a transmembrane protein (fTMP), wherein the fTMP comprises the CSR transmembrane domain. In some embodiments, the co-stimulatory signaling domain comprises, consists essentially of, or consists of all or a portion of the intracellular domain of an immune cell co-stimulatory molecule including, for example, CD27, CD28, 4-1BB (CD137), OX40, CD30, CD40, ICOS, lymphocyte function-associated antigen-1 (LFA-1), CD2, CD7, LIGHT, NKG2C, B7-H3, a ligand that specifically binds with CD83, and the like. In some embodiments, the CSR comprises a fragment of an immune cell co-stimulatory molecule (fCSM), wherein the fCSM comprises the CSR transmembrane domain and CSR co-stimulatory signaling domain. In some embodiments, the CSR further comprises a spacer domain between any of the ligand-binding domain, the transmembrane domain, and the co-stimulatory signaling domain. In some embodiments, the spacer domain comprises a peptide linker connecting two CSR domains.

In some embodiments, the CSR described herein specifically binds to a target ligand (e.g., CD22), comprising a) a target ligand-binding domain; b) a transmembrane domain; and c) and a co-stimulatory signaling domain, wherein the target ligand is a peptide/MHC complex, and wherein the CSR is capable of stimulating an immune cell on the surface of which it is functionally expressed upon target ligand binding. In some embodiments, the target ligand is the same as the target antigen of a caTCR expressed in the same immune cell. In some embodiments, the target ligand is different from the target antigen of a caTCR expressed in the same immune cell. In some embodiments, the target ligand is a disease-associated ligand. In some embodiments, the target ligand is a cancer-associated ligand. In some embodiments, the cancer-associated ligand is a peptide/MHC complex comprising a peptide derived from a protein including WT-1, AFP, HPV16-E7, NY-ESO-1, PRAME, EBV-LMP2A, or PSA. In some embodiments, the target ligand is a virus-associated ligand. In some embodiments, the ligand-binding domain is an antibody moiety. In some embodiments, the antibody moiety is a Fab, a Fab', a (Fab')2, an Fv, or a single chain Fv (scFv). In some embodiments, the transmembrane domain comprises a transmembrane domain derived from a transmembrane protein including, for example, CD28, CD3ε, CD3ζ, CD45, CD4, CD5, CD8, CD9, CD16, CD22, CD33, CD37, CD64, CD80, CD86, CD134, CD137, or CD154. In some embodiments, the CSR comprises a fragment of a transmembrane protein (fTMP), wherein the fTMP comprises the CSR transmembrane domain. In some embodiments, the co-stimulatory signaling domain comprises, consists essentially of, or consists of all or a portion of the intracellular domain of an immune cell co-stimulatory molecule including, for example, CD27, CD28, 4-1BB (CD137), OX40, CD30, CD40, ICOS, lymphocyte function-associated antigen-1 (LFA-1), CD2, CD7, LIGHT, NKG2C, B7-H3, a ligand that specifically binds with CD83, and the like. In some embodiments, the CSR comprises a fragment of an immune cell co-stimulatory molecule (fCSM), wherein the fCSM comprises the CSR transmembrane domain and CSR co-stimulatory signaling domain. In some embodiments, the CSR further comprises a spacer domain between any of the ligand-binding domain, the transmembrane domain, and the co-stimulatory signaling domain. In some embodiments, the spacer domain comprises a peptide linker connecting two CSR domains.

In some embodiments, the CSR described herein specifically binds to a target ligand (e.g., CD22), comprising a) a target ligand-binding domain; b) a transmembrane domain; and c) and a co-stimulatory signaling domain, wherein the ligand-binding domain is an antibody moiety, and wherein the CSR is capable of stimulating an immune cell on the surface of which it is functionally expressed upon target ligand binding. In some embodiments, the target ligand is a cell surface antigen. In some embodiments, the target ligand is a peptide/MHC complex. In some embodiments, the target ligand is the same as the target antigen of a caTCR expressed in the same immune cell. In some embodiments, the target ligand is different from the target antigen of a caTCR expressed in the same immune cell. In some embodiments, the target ligand is a disease-associated ligand. In some embodiments, the target ligand is a cancer-associated ligand. In some embodiments, the cancer-associated ligand is, for example, CD19, CD20, CD47, IL4, GPC-3, ROR1, ROR2, BCMA, GPRC5D, or FCRL5. In some embodiments, the cancer-associated ligand is a peptide/MHC complex comprising a peptide derived from a protein including WT-1, AFP, HPV16-E7, NY-ESO-1, PRAIVIE, EBV-LMP2A, and PSA. In some embodiments, the target ligand is a virus-associated ligand. In some embodiments, the target ligand is an immune checkpoint molecule. In some embodiments, the immune checkpoint molecule includes PD-L1, PD-L2, CD80, CD86, ICOSL, B7-H3, B7-H4, HVEM, 4-1BBL, OX40L, CD70, CD40, and GAL9. In some embodiments, the target ligand is an apoptotic molecule. In some embodiments, the apoptotic molecule includes FasL, FasR, TNFR1, and TNFR2. In some embodiments, the antibody moiety is a Fab, a Fab', a (Fab')2, an Fv, or a single chain Fv (scFv). In some embodiments, the transmembrane domain comprises a transmembrane domain derived from a transmembrane protein including, for example, CD28, CD3ε, CD3ζ, CD45, CD4, CD5, CD8, CD9, CD16, CD22, CD33, CD37, CD64, CD80, CD86, CD134, CD137, or CD154. In some embodiments, the CSR comprises a fragment of a transmembrane protein (fTMP), wherein the fTMP comprises the CSR transmembrane domain. In some embodiments, the co-stimulatory signaling domain comprises, consists essentially of, or consists of all or a portion of the intracellular domain of an immune cell co-stimulatory molecule including, for example, CD27, CD28, 4-1BB (CD137), OX40, CD30, CD40, ICOS, lymphocyte function-associated antigen-1 (LFA-1), CD2, CD7, LIGHT, NKG2C, B7-H3, a ligand that specifically binds with CD83, and the like. In some embodiments, the CSR comprises a fragment of an immune cell co-stimulatory molecule (fCSM), wherein the fCSM comprises the CSR transmembrane domain and CSR co-stimulatory signaling domain. In some embodiments, the CSR further comprises a spacer domain between any of the ligand-binding domain, the transmembrane domain, and the co-stimulatory signaling domain. In some embodiments, the spacer domain comprises a peptide linker connecting two CSR domains.

In some embodiments, the CSR described herein specifically binds to a target ligand (e.g., CD22), comprising a) a target ligand-binding domain; b) a transmembrane domain; and c) a co-stimulatory signaling domain, wherein the ligand-binding domain is (or is derived from) all or a portion of the extracellular domain of a receptor for the target ligand, and wherein the CSR is capable of stimulating an immune cell on the surface of which it is functionally expressed upon target ligand binding. In some embodiments, the target ligand is a cell surface antigen. In some embodiments, the target ligand is the same as the target antigen of a caTCR expressed in the same immune cell. In some embodiments, the target ligand is different from the target antigen of a caTCR expressed in the same immune cell. In some embodiments, the target ligand is a disease-associated ligand. In some embodiments, the target ligand is a cancer-associated ligand. In some embodiments, the cancer-associated ligand is, for example, CD19, CD20, CD47, IL4, GPC-3, ROR1, ROR2, BCMA, GPRC5D, or FCRL5. In some embodiments, the target ligand is an immune checkpoint molecule. In some embodiments, the immune checkpoint molecule includes PD-L1, PD-L2, CD80, CD86, ICOSL, B7-H3, B7-H4, HVEM, 4-1BBL, OX40L, CD70, CD40, and GAL9. In some embodiments, the target ligand is an apoptotic molecule. In some embodiments, the apoptotic molecule includes FasL, FasR, TNFR1, and TNFR2. In some embodiments, the target ligand receptor includes, for example, FasR, TNFR1, TNFR2, PD-1, CD28, CTLA-4, ICOS, BTLA, KIR, LAG-3, 4-1BB, OX40, CD27, and TIM-3. In some embodiments, the transmembrane domain comprises a transmembrane domain derived from, for example, CD28, CD3ε, CD3ζ, CD45, CD4, CD5, CD8, CD9, CD16, CD22, CD33, CD37, CD64, CD80, CD86, CD134, CD137, or CD154. In some embodiments, the co-stimulatory signaling domain comprises, consists essentially of, or consists of all or a portion of the intracellular domain of an immune cell co-stimulatory molecule including, for example, CD27, CD28, 4-1BB (CD137), OX40, CD30, CD40, ICOS, lymphocyte function-associated antigen-1 (LFA-1), CD2, CD7, LIGHT, NKG2C, B7-H3, a ligand that specifically binds with CD83, and the like. In some embodiments, the CSR further comprises a spacer domain between any of the ligand-binding domain, the transmembrane domain, and the co-stimulatory signaling domain. In some embodiments, the spacer domain comprises a peptide linker connecting two CSR domains.

In some embodiments, the CSR described herein specifically binds to CD22, comprising an scFv comprising a $V_H$ domain having the amino acid sequence of SEQ ID NO: 219 and a $V_L$ domain having the amino acid sequence of SEQ ID NO: 218. In some embodiments, the scFv comprises, from amino terminus to carboxy terminus, the $V_L$ domain, a peptide linker comprising the amino acid sequence of SEQ ID NO: 233, and the $V_H$ domain.

In some embodiments, the CSR described herein specifically binds to CD22, comprising an scFv comprising a $V_H$ domain having the amino acid sequence of SEQ ID NO: 213 and a $V_L$ domain having the amino acid sequence of SEQ ID NO: 212. In some embodiments, the scFv comprises, from amino terminus to carboxy terminus, the $V_L$ domain, a peptide linker comprising the amino acid sequence of SEQ ID NO: 233, and the $V_H$ domain.

In some embodiments, a CSR can be an anti-CD22 CSR, an anti-CD19 CSR, or an anti-CD20 CSR. The CSR can comprise an intracellular fragment (i.e., a co-stimulatory immune cell signaling sequence), which can be a portion of the intracellular domain of a co-stimulatory molecule. Examples of co-stimulatory molecules include, but are not limited to, CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, a ligand that specifically binds with CD83, and the like. In some embodiments, the CSR can comprise a transmembrane fragment, which can be a fragment of the transmembrane portion of the co-stimulatory molecule. In some embodiments, the intracellular fragment and the transmembrane fragment in the CSR can be from the same co-stimulatory molecule (e.g., CD28 or CD30). In some embodiments, the intracellular fragment and the transmembrane fragment in the CSR can be from the different co-stimulatory molecules. In some embodiments, the intracellular fragment can be taken from a first co-stimulatory molecule and fused to the transmembrane fragment from a second co-stimulatory molecule. For example, the transmembrane fragment can be from the transmembrane portion of CD8 and the intracellular fragment can be from the intracellular domain of CD30. In some embodiments, when the intracellular fragment and the transmembrane fragment in the CSR are from the same co-stimulatory molecule, the intracellular fragment and the transmembrane fragment can be taken from a single co-stimulatory molecule (e.g., a single CD28 or a single CD30). In other embodiments, when the intracellular fragment and the transmembrane fragment in the CSR are from the same co-stimulatory molecule, the intracellular fragment can be taken from a first co-stimulatory molecule (e.g., a first CD28) and fused to the transmembrane fragment taken from a second co-stimulatory molecule (e.g., a second CD28).

In some embodiments, an anti-CD19 CSR comprises a sequence that has at least 90% (e.g., 92%, 94%, 96%, 98%, 99%, or 100%) identity to the sequence of any one of SEQ ID NOS: 81-96. In some embodiments, an anti-CD22 CSR comprises a sequence that has at least 90% (e.g., 92%, 94%, 96%, 98%, 99%, or 100%) identity to the sequence of any one of SEQ ID NOS: 97-112. In some embodiments, an anti-CD20 CSR comprises a sequence that has at least 90% (e.g., 92%, 94%, 96%, 98%, 99%, or 100%) identity to the sequence of any one of SEQ ID NOS: 113-128. In some embodiments, a CSR comprises a sequence that has at least 90% (e.g., 92%, 94%, 96%, 98%, 99%, or 100%) identity to the sequence of any one of SEQ ID NOS: 129-144.

In some embodiments, the expression of the CSR in the caTCR plus CSR immune cell is inducible. In some embodiments, the caTCR plus CSR immune cell comprises a nucleic acid sequence encoding the CSR operably linked to an inducible promoter, including any of the inducible promoters described herein. In some embodiments, the expression of the CSR in the caTCR plus CSR immune cell is inducible upon signaling through the caTCR. In some such embodiments, the caTCR plus CSR immune cell comprises a nucleic acid sequence encoding the CSR operably linked to a promoter or regulatory element responsive to signaling through the caTCR. In some embodiments, the nucleic acid sequence encoding the CSR is operably linked to a nuclear-factor of the activated T-cell (NFAT)-derived promoter. In some embodiments, the NFAT-derived promoter is an NFAT-derived minimal promoter (see for example Durand, D. et. al., *Molec. Cell. Biol.* 8, 1715-1724 (1988); Clipstone, N A, Crabtree, G R. *Nature.* 1992 357(6380): 695-7; Chmielewski, M., et al. *Cancer research* 71.17 (2011): 5697-5706; and Zhang, L., et al. *Molecular therapy* 19.4 (2011): 751-759).

Also provided herein are effector cells (such as lymphocytes, e.g., T cells) expressing an anti-CD22 construct, such as an anti-CD22 CAR, anti-CD22 caTCR, or anti-CD22 CSR.

Also provided is a method of producing an effector cell expressing an anti-CD22 CAR, anti-CD22 caTCR, or anti-CD22 CSR, the method comprising introducing a vector comprising a nucleic acid encoding the anti-CD22 CAR, anti-CD22 caTCR, or anti-CD22 CSR into the effector cell. In some embodiments, introducing the vector into the effector cell comprises transducing the effector cell with the vector. In some embodiments, introducing the vector into the effector cell comprises transfecting the effector cell with the vector. Transduction or transfection of the vector into the effector cell can be carried about using any method known in the art.

Monospecific Constructs

The invention features monospecific constructs that specifically bind to a target ligand (such as a cell surface antigen or a peptide/MHC complex) and are capable of stimulating an immune cell on the surface of which they are functionally expressed upon target ligand binding. In some embodiments, the monospecific construct specifically targets CD22. In some embodiments, a monospecific construct can be a caTCR, a CSR, a CAR, a full-length antibody, a Fab, a Fab', a F(ab')2, an Fv, a single chain Fv (scFv) antibody, a tandem scFv, a diabody (Db), a single chain diabody (scDb), a dual-affinity retargeting (DART) antibody, a dual variable domain (DVD) antibody, a knob-into-hole (KiH) antibody, a dock and lock (DNL) antibody, a chemically cross-linked antibody, a heteromultimeric antibody, or a heteroconjugate antibody.

In some embodiments, a monospecific construct is an anti-CD22 construct comprising an anti-CD22 antibody moiety. In certain embodiments, the anti-CD22 antibody moiety comprises: (a) the light chain variable region (VL) comprising a sequence having at least 90% (e.g., 92%, 94%, 96%, 98%, 99%, or 100%) identity to the sequence of SEQ ID NO: 212; and (b) a heavy chain variable region (VH) comprising a sequence having at least 90% (e.g., 92%, 94%, 96%, 98%, 99%, or 100%) identity to the sequence of SEQ ID NO: 213. In certain embodiments, the anti-CD22 antibody moiety comprises: (a) the light chain variable region (VL) comprising a sequence having at least 90% (e.g., 92%, 94%, 96%, 98%, 99%, or 100%) identity to the sequence of SEQ ID NO: 218; and (b) a heavy chain variable region (VH) comprising a sequence having at least 90% (e.g., 92%, 94%, 96%, 98%, 99%, or 100%) identity to the sequence of SEQ ID NO: 219. In other embodiments, the anti-CD22 antibody moiety comprises an anti-CD22 scFv comprising a sequence having at least 90% (e.g., 92%, 94%, 96%, 98%, 99%, or 100%) identity to the sequence of SEQ ID NO: 186.

In some embodiments, a monospecific anti-CD22 construct is a caTCR, a CSR, a CAR, or an antibody, each of which can be monovalent or multivalent (e.g., bivalent, trivalent, quad-valent). For example, construct 4 (SEQ ID NO: 4) comprises an anti-CD22 scFv and an anti-CD22 Fab and is also referred to as a "bivalent-monospecific" construct. In some embodiments, a monospecific anti-CD22 construct is a multivalent caTCR, which can contain multiple Fabs or combinations of Fabs and scFvs.

In some embodiments, a monospecific construct can be a caTCR, e.g., an anti-CD22 caTCR, an anti-CD19 caTCR, or an anti-CD20 caTCR. In some embodiments, a monospecific caTCR comprises a sequence that has at least 90% (e.g., 92%, 94%, 96%, 98%, 99%, or 100%) identity to the sequence of any one of SEQ ID NOS: 2, 4, 22, 28, and 76-80.

In some embodiments, a monospecific construct can be a CSR, e.g., an anti-CD22 CSR, an anti-CD19 CSR, or an anti-CD20 CSR. In some embodiments, an anti-CD19 CSR comprises a sequence that has at least 90% (e.g., 92%, 94%, 96%, 98%, 99%, or 100%) identity to the sequence of any one of SEQ ID NOS: 81-96. In some embodiments, an anti-CD22 CSR comprises a sequence that has at least 90% (e.g., 92%, 94%, 96%, 98%, 99%, or 100%) identity to the sequence of any one of SEQ ID NOS: 97-112. In some embodiments, an anti-CD20 CSR comprises a sequence that has at least 90% (e.g., 92%, 94%, 96%, 98%, 99%, or 100%) identity to the sequence of any one of SEQ ID NOS: 113-128.

Multispecific Constructs

In some embodiments, the anti-CD22 constructs can be multispecific (e.g., bispecific). Multispecific anti-CD22 constructs have antibody moieties against more than one target. In some embodiments, a multispecific anti-CD22 construct has one antibodity moiety against CD22 and one or more additional antibody moieties against one or more non-CD22 antigens (e.g., CD19, CD20, a non-CD22 antigen expressed in B-cell malignancy). In some embodiments, a multispecific anti-CD22 construct can be bispecific, trispecific, quad-specific, or quint-specific. In some embodiments, a multispecific anti-CD22 construct can be a caTCR, a CSR, a CAR, a full-length antibody, a Fab, a Fab', a F(ab')2, an Fv, a single chain Fv (scFv) antibody, a tandem scFv, a diabody (Db), a single chain diabody (scDb), a dual-affinity retargeting (DART) antibody, a dual variable domain (DVD) antibody, a knob-into-hole (KiH) antibody, a dock and lock (DNL) antibody, a chemically cross-linked antibody, a heteromultimeric antibody, or a heteroconjugate antibody.

Multispecific Constructs—Bispecific Constructs

The invention features bispecific constructs that specifically bind to two target ligands (such as cell surface antigens or peptide/MHC complexes) and are capable of stimulating an immune cell on the surface of which they are functionally expressed upon target ligand binding. In some embodiments, the bispecific construct specifically targets CD22 and CD19. In other embodiments, the bispecific construct specifically targets CD22 and CD20.

In some embodiments, a bispecific construct can be a caTCR, e.g., an anti-CD22-anti-CD19 caTCR. In some embodiments, a bispecific caTCR comprises a sequence that has at least 90% (e.g., 92%, 94%, 96%, 98%, 99%, or 100%) identity to the sequence of any one of SEQ ID NOS: 15-21.

In some embodiments, a bispecific construct can be a CSR. In some embodiments, a bispecific CSR comprises a sequence that has at least 90% (e.g., 92%, 94%, 96%, 98%, 99%, or 100%) identity to the sequence of any one of SEQ ID NOS: 129-144.

Multispecific Constructs—Trispecific Constructs

The invention features trispecific constructs that specifically bind to three target ligands (such as cell surface antigens or peptide/MHC complexes) and are capable of stimulating an immune cell on the surface of which they are functionally expressed upon target ligand binding. In some embodiments, the trispecific construct specifically targets CD22, CD19, and CD20.

In some embodiments, a trispecific construct comprises a sequence that has at least 90% (e.g., 92%, 94%, 96%, 98%, 99%, or 100%) identity to the sequence of any one of SEQ ID NOS: 24-27. In some embodiments, the FLGA tag (SEQ ID NO: 195) is removed from the sequence of any one of SEQ ID NOS: 24-27.

Construct Combinations

The invention features construct combinations comprising at least two different constructs of the invention. In some embodiments, the at least two different constructs are of the same kind of constructs, e.g., two different antibodies (e.g., two different full-length IgG or two different bispecific antibodies), two different CARs, two different caTCRs, or two different CSRs. In some embodiments, the at least two different constructs are of different kinds of constructs, e.g., an antibody plus a CAR, an antibody plus a caTCR, a CAR plus a CSR, a caTCR plus a CSR, etc. In some embodiments, the construct combination comprises at least one monospecific construct. In some embodiments, the construct combination comprises at least one multispecific construct. In some embodiments, the construct combination comprises at least one monospecific construct and at least one multispecific construct. In some embodiments, the at least two different constructs in the construct combination have antibody moieties against at least one common target. In some embodiments, the at least two different constructs in the construct combination do not have antibody moieties against any common targets.

In some embodiments, the construct combination comprises at least one anti-CD22 construct of the invention. In some embodiments, the at least one anti-CD22 construct is an antibody, a CAR, a caTCR, or a CSR. In some embodiments, the at least one anti-CD22 construct is a monospecific construct. In some embodiments, the at least one anti-CD22 construct is a multispecific construct. In some embodiments, the at least one anti-CD22 construct is an anti-CD22 caTCR, and the construct combination comprises a CSR. In some embodiments, the anti-CD22 caTCR is expressed in combination with the CSR. In some embodiments, the at least one anti-CD22 construct is an anti-CD22 CSR, and the construct combination comprises a caTCR. In some embodiments, the anti-CD22 CSR is expressed in combination with the caTCR.

Construct Combinations Comprising Monospecific Constructs

In some embodiments, the construct combination comprises at least one monospecific construct which specifically binds to a target ligand (such as a cell surface antigen or a peptide/WIC complex) and is capable of stimulating an immune cell on the surface of which it is functionally expressed upon target ligand binding. In some embodiments, the monospecific construct specifically targets CD22.

In some embodiments, the construct combination comprises a monospecific construct, and the construct combination comprises a sequence that has at least 90% (e.g., 92%, 94%, 96%, 98%, 99%, or 100%) identity to the sequence of any one of SEQ ID NOS: 1, 3, and 5-14.

In some embodiments, the construct combination comprises a monospecific caTCR and a CSR, in which the caTCR has a sequence that has at least 90% (e.g., 92%, 94%, 96%, 98%, 99%, or 100%) identity to the sequence of SEQ ID NO: 77 and the CSR has a sequence that has at least 90% (e.g., 92%, 94%, 96%, 98%, 99%, or 100%) identity to the sequence of any one of SEQ ID NOS: 81-96.

In some embodiments, the construct combination comprises a monospecific caTCR and a CSR, in which the caTCR has a sequence that has at least 90% (e.g., 92%, 94%, 96%, 98%, 99%, or 100%) identity to the sequence of SEQ ID NO: 77 and the CSR has a sequence that has at least 90% (e.g., 92%, 94%, 96%, 98%, 99%, or 100%) identity to the sequence of any one of SEQ ID NOS: 97-112.

In some embodiments, the construct combination comprises a monospecific caTCR and a CSR, in which the caTCR has a sequence that has at least 90% (e.g., 92%, 94%, 96%, 98%, 99%, or 100%) identity to the sequence of SEQ ID NO: 77 and the CSR has a sequence that has at least 90% (e.g., 92%, 94%, 96%, 98%, 99%, or 100%) identity to the sequence of any one of SEQ ID NOS: 113-128.

In some embodiments, the construct combination comprises a monospecific caTCR and a CSR, in which the caTCR has a sequence that has at least 90% (e.g., 92%, 94%, 96%, 98%, 99%, or 100%) identity to the sequence of SEQ ID NO: 78 and the CSR has a sequence that has at least 90% (e.g., 92%, 94%, 96%, 98%, 99%, or 100%) identity to the sequence of any one of SEQ ID NOS: 81-96.

In some embodiments, the construct combination comprises a monospecific caTCR and a CSR, in which the caTCR has a sequence that has at least 90% (e.g., 92%, 94%, 96%, 98%, 99%, or 100%) identity to the sequence of SEQ ID NO: 78 and the CSR has a sequence that has at least 90% (e.g., 92%, 94%, 96%, 98%, 99%, or 100%) identity to the sequence of any one of SEQ ID NOS: 97-112.

In some embodiments, the construct combination comprises a monospecific caTCR and a CSR, in which the caTCR has a sequence that has at least 90% (e.g., 92%, 94%, 96%, 98%, 99%, or 100%) identity to the sequence of SEQ ID NO: 78 and the CSR has a sequence that has at least 90% (e.g., 92%, 94%, 96%, 98%, 99%, or 100%) identity to the sequence of any one of SEQ ID NOS: 113-128.

In some embodiments, the construct combination comprises a monospecific caTCR and a CSR, in which the caTCR has a sequence that has at least 90% (e.g., 92%, 94%, 96%, 98%, 99%, or 100%) identity to the sequence of any one of SEQ ID NOS: 77 and the CSR has a sequence that comprises a transmembrane fragment of CD8, 4-1BB, CD27, CD28, CD30, or OX40. In some embodiments, the transmembrane fragment has a sequence of any one of SEQ ID NOS: 145-150. In some embodiments, the CSR comprises an anti-CD22 moiety.

In some embodiments, the construct combination comprises a monospecific caTCR and a CSR, in which the caTCR has a sequence that has at least 90% (e.g., 92%, 94%, 96%, 98%, 99%, or 100%) identity to the sequence of any one of SEQ ID NOS: 77 and the CSR has a sequence that comprises an intracellular fragment of a molecule selected from the group consisting of CD28, 4-1BB (CD137), OX40, CD30, and CD27. In some embodiments, the intracellular fragment comprises a sequence of any one of SEQ ID NOS: 151-155. In some embodiments, the CSR comprises an anti-CD22 moiety.

In some embodiments, the construct combination comprises a monospecific caTCR and a CSR, in which the caTCR has a sequence that has at least 90% (e.g., 92%, 94%, 96%, 98%, 99%, or 100%) identity to the sequence of any one of SEQ ID NOS: 77 and the CSR has a sequence that comprises a sequence of any one of SEQ ID NOS: 156-171. In some embodiments, the CSR comprises an anti-CD22 moiety.

In any one of the construct combinations disclosed herein, in some embodiments, each caTCR and CSR can be encoded by a single nucleic acid, expressed, and translated as a single polypeptide initially, and then get cleaved into separate polypeptides. The caTCR and the CSR can be connected via a cleavable P2A peptide (e.g., SEQ ID NO: 190). In other embodiments, the caTCR and the CSR can be encoded by two different nucleic acids, expressed, and separately translated separate polypeptides.

Construct Combinations Comprising Bispecific Constructs

In some embodiments, the construct combination comprises at least one bispecific construct which specifically binds to two target ligands (such as cell surface antigens or peptide/MHC complexes) and is capable of stimulating an immune cell on the surface of which it is functionally expressed upon target ligand binding. In some embodiments, the bispecific construct specifically targets CD22 and CD19. In other embodiments, the bispecific construct specifically targets CD22 and CD20.

In some embodiments, the construct combination comprises a bispecific construct, and the construct combination comprises a sequence that has at least 90% (e.g., 92%, 94%, 96%, 98%, 99%, or 100%) identity to the sequence of any one of SEQ ID NOS: 23 and 29-75.

In some embodiments, the construct combination comprises a bispecific caTCR and a CSR, in which the caTCR has a sequence that has at least 90% (e.g., 92%, 94%, 96%, 98%, 99%, or 100%) identity to the sequence of SEQ ID NO: 15 and the CSR has a sequence that has at least 90% (e.g., 92%, 94%, 96%, 98%, 99%, or 100%) identity to the sequence of any one of SEQ ID NOS: 81-96.

In some embodiments, the construct combination comprises a bispecific caTCR and a CSR, in which the caTCR has a sequence that has at least 90% (e.g., 92%, 94%, 96%, 98%, 99%, or 100%) identity to the sequence of SEQ ID NO: 16 and the CSR has a sequence that has at least 90% (e.g., 92%, 94%, 96%, 98%, 99%, or 100%) identity to the sequence of any one of SEQ ID NOS: 81-96.

In some embodiments, the construct combination comprises a bispecific caTCR and a CSR, in which the caTCR has a sequence that has at least 90% (e.g., 92%, 94%, 96%, 98%, 99%, or 100%) identity to the sequence of SEQ ID NO: 17 and the CSR has a sequence that has at least 90% (e.g., 92%, 94%, 96%, 98%, 99%, or 100%) identity to the sequence of any one of SEQ ID NOS: 81-96.

In some embodiments, the construct combination comprises a bispecific caTCR and a CSR, in which the caTCR has a sequence that has at least 90% (e.g., 92%, 94%, 96%, 98%, 99%, or 100%) identity to the sequence of SEQ ID NO: 18 and the CSR has a sequence that has at least 90% (e.g., 92%, 94%, 96%, 98%, 99%, or 100%) identity to the sequence of any one of SEQ ID NOS: 81-96.

In some embodiments, the construct combination comprises a bispecific caTCR and a CSR, in which the caTCR has a sequence that has at least 90% (e.g., 92%, 94%, 96%, 98%, 99%, or 100%) identity to the sequence of SEQ ID NO: 19 and the CSR has a sequence that has at least 90% (e.g., 92%, 94%, 96%, 98%, 99%, or 100%) identity to the sequence of any one of SEQ ID NOS: 81-96.

In some embodiments, the construct combination comprises a bispecific caTCR and a CSR, in which the caTCR has a sequence that has at least 90% (e.g., 92%, 94%, 96%, 98%, 99%, or 100%) identity to the sequence of SEQ ID NO: 20 and the CSR has a sequence that has at least 90% (e.g., 92%, 94%, 96%, 98%, 99%, or 100%) identity to the sequence of any one of SEQ ID NOS: 81-96.

In some embodiments, the construct combination comprises a bispecific caTCR and a CSR, in which the caTCR has a sequence that has at least 90% (e.g., 92%, 94%, 96%, 98%, 99%, or 100%) identity to the sequence of SEQ ID NO: 21 and the CSR has a sequence that has at least 90% (e.g., 92%, 94%, 96%, 98%, 99%, or 100%) identity to the sequence of any one of SEQ ID NOS: 81-96.

In some embodiments, the construct combination comprises a bispecific caTCR and a CSR, in which the caTCR has a sequence that has at least 90% (e.g., 92%, 94%, 96%, 98%, 99%, or 100%) identity to the sequence of SEQ ID NO: 15 and the CSR has a sequence that has at least 90% (e.g., 92%, 94%, 96%, 98%, 99%, or 100%) identity to the sequence of any one of SEQ ID NOS: 97-112.

In some embodiments, the construct combination comprises a bispecific caTCR and a CSR, in which the caTCR has a sequence that has at least 90% (e.g., 92%, 94%, 96%, 98%, 99%, or 100%) identity to the sequence of SEQ ID NO: 16 and the CSR has a sequence that has at least 90% (e.g., 92%, 94%, 96%, 98%, 99%, or 100%) identity to the sequence of any one of SEQ ID NOS: 97-112.

In some embodiments, the construct combination comprises a bispecific caTCR and a CSR, in which the caTCR has a sequence that has at least 90% (e.g., 92%, 94%, 96%, 98%, 99%, or 100%) identity to the sequence of SEQ ID NO: 17 and the CSR has a sequence that has at least 90% (e.g., 92%, 94%, 96%, 98%, 99%, or 100%) identity to the sequence of any one of SEQ ID NOS: 97-112.

In some embodiments, the construct combination comprises a bispecific caTCR and a CSR, in which the caTCR has a sequence that has at least 90% (e.g., 92%, 94%, 96%, 98%, 99%, or 100%) identity to the sequence of SEQ ID NO: 18 and the CSR has a sequence that has at least 90% (e.g., 92%, 94%, 96%, 98%, 99%, or 100%) identity to the sequence of any one of SEQ ID NOS: 97-112.

In some embodiments, the construct combination comprises a bispecific caTCR and a CSR, in which the caTCR has a sequence that has at least 90% (e.g., 92%, 94%, 96%, 98%, 99%, or 100%) identity to the sequence of SEQ ID NO: 19 and the CSR has a sequence that has at least 90% (e.g., 92%, 94%, 96%, 98%, 99%, or 100%) identity to the sequence of any one of SEQ ID NOS: 97-112.

In some embodiments, the construct combination comprises a bispecific caTCR and a CSR, in which the caTCR has a sequence that has at least 90% (e.g., 92%, 94%, 96%, 98%, 99%, or 100%) identity to the sequence of SEQ ID NO: 20 and the CSR has a sequence that has at least 90% (e.g., 92%, 94%, 96%, 98%, 99%, or 100%) identity to the sequence of any one of SEQ ID NOS: 97-112.

In some embodiments, the construct combination comprises a bispecific caTCR and a CSR, in which the caTCR has a sequence that has at least 90% (e.g., 92%, 94%, 96%, 98%, 99%, or 100%) identity to the sequence of SEQ ID NO: 21 and the CSR has a sequence that has at least 90% (e.g., 92%, 94%, 96%, 98%, 99%, or 100%) identity to the sequence of any one of SEQ ID NOS: 97-112.

In some embodiments, the construct combination comprises a bispecific caTCR and a CSR, in which the caTCR has a sequence that has at least 90% (e.g., 92%, 94%, 96%, 98%, 99%, or 100%) identity to the sequence of SEQ ID NO: 15 and the CSR has a sequence that has at least 90% (e.g., 92%, 94%, 96%, 98%, 99%, or 100%) identity to the sequence of any one of SEQ ID NOS: 113-128.

In some embodiments, the construct combination comprises a bispecific caTCR and a CSR, in which the caTCR has a sequence that has at least 90% (e.g., 92%, 94%, 96%, 98%, 99%, or 100%) identity to the sequence of SEQ ID NO: 16 and the CSR has a sequence that has at least 90% (e.g., 92%, 94%, 96%, 98%, 99%, or 100%) identity to the sequence of any one of SEQ ID NOS: 113-128.

In some embodiments, the construct combination comprises a bispecific caTCR and a CSR, in which the caTCR has a sequence that has at least 90% (e.g., 92%, 94%, 96%, 98%, 99%, or 100%) identity to the sequence of SEQ ID NO: 17 and the CSR has a sequence that has at least 90% (e.g., 92%, 94%, 96%, 98%, 99%, or 100%) identity to the sequence of any one of SEQ ID NOS: 113-128.

In some embodiments, the construct combination comprises a bispecific caTCR and a CSR, in which the caTCR has a sequence that has at least 90% (e.g., 92%, 94%, 96%, 98%, 99%, or 100%) identity to the sequence of SEQ ID NO: 18 and the CSR has a sequence that has at least 90% (e.g., 92%, 94%, 96%, 98%, 99%, or 100%) identity to the sequence of any one of SEQ ID NOS: 113-128.

In some embodiments, the construct combination comprises a bispecific caTCR and a CSR, in which the caTCR has a sequence that has at least 90% (e.g., 92%, 94%, 96%, 98%, 99%, or 100%) identity to the sequence of SEQ ID NO: 19 and the CSR has a sequence that has at least 90% (e.g., 92%, 94%, 96%, 98%, 99%, or 100%) identity to the sequence of any one of SEQ ID NOS: 113-128.

In some embodiments, the construct combination comprises a bispecific caTCR and a CSR, in which the caTCR has a sequence that has at least 90% (e.g., 92%, 94%, 96%, 98%, 99%, or 100%) identity to the sequence of SEQ ID NO: 20 and the CSR has a sequence that has at least 90% (e.g., 92%, 94%, 96%, 98%, 99%, or 100%) identity to the sequence of any one of SEQ ID NOS: 113-128.

In some embodiments, the construct combination comprises a bispecific caTCR and a CSR, in which the caTCR has a sequence that has at least 90% (e.g., 92%, 94%, 96%, 98%, 99%, or 100%) identity to the sequence of SEQ ID NO: 21 and the CSR has a sequence that has at least 90% (e.g., 92%, 94%, 96%, 98%, 99%, or 100%) identity to the sequence of any one of SEQ ID NOS: 113-128.

In some embodiments, the construct combination comprises a bispecific caTCR and a CSR, in which the caTCR has a sequence that has at least 90% (e.g., 92%, 94%, 96%, 98%, 99%, or 100%) identity to the sequence of SEQ ID NO: 15 and the CSR has a sequence that has at least 90% (e.g., 92%, 94%, 96%, 98%, 99%, or 100%) identity to the sequence of any one of SEQ ID NOS: 129-144.

In some embodiments, the construct combination comprises a bispecific caTCR and a CSR, in which the caTCR has a sequence that has at least 90% (e.g., 92%, 94%, 96%, 98%, 99%, or 100%) identity to the sequence of SEQ ID NO: 16 and the CSR has a sequence that has at least 90% (e.g., 92%, 94%, 96%, 98%, 99%, or 100%) identity to the sequence of any one of SEQ ID NOS: 129-144.

In some embodiments, the construct combination comprises a bispecific caTCR and a CSR, in which the caTCR has a sequence that has at least 90% (e.g., 92%, 94%, 96%, 98%, 99%, or 100%) identity to the sequence of SEQ ID NO: 17 and the CSR has a sequence that has at least 90% (e.g., 92%, 94%, 96%, 98%, 99%, or 100%) identity to the sequence of any one of SEQ ID NOS: 129-144.

In some embodiments, the construct combination comprises a bispecific caTCR and a CSR, in which the caTCR has a sequence that has at least 90% (e.g., 92%, 94%, 96%, 98%, 99%, or 100%) identity to the sequence of SEQ ID NO: 18 and the CSR has a sequence that has at least 90% (e.g., 92%, 94%, 96%, 98%, 99%, or 100%) identity to the sequence of any one of SEQ ID NOS: 129-144.

In some embodiments, the construct combination comprises a bispecific caTCR and a CSR, in which the caTCR has a sequence that has at least 90% (e.g., 92%, 94%, 96%, 98%, 99%, or 100%) identity to the sequence of SEQ ID NO: 19 and the CSR has a sequence that has at least 90% (e.g., 92%, 94%, 96%, 98%, 99%, or 100%) identity to the sequence of any one of SEQ ID NOS: 129-144.

In some embodiments, the construct combination comprises a bispecific caTCR and a CSR, in which the caTCR has a sequence that has at least 90% (e.g., 92%, 94%, 96%, 98%, 99%, or 100%) identity to the sequence of SEQ ID NO: 20 and the CSR has a sequence that has at least 90% (e.g., 92%, 94%, 96%, 98%, 99%, or 100%) identity to the sequence of any one of SEQ ID NOS: 129-144.

In some embodiments, the construct combination comprises a bispecific caTCR and a CSR, in which the caTCR has a sequence that has at least 90% (e.g., 92%, 94%, 96%, 98%, 99%, or 100%) identity to the sequence of SEQ ID NO: 21 and the CSR has a sequence that has at least 90% (e.g., 92%, 94%, 96%, 98%, 99%, or 100%) identity to the sequence of any one of SEQ ID NOS: 129-144.

In any one of the construct combinations comprising a bispecific caTCR and a CSR disclosed herein, in some embodiments, each caTCR and CSR can be encoded by a single nucleic acid, expressed, and translated as a single polypeptide initially, and then get cleaved into separate polypeptides. The caTCR and the CSR can be connected via a cleavable P2A peptide (e.g., SEQ ID NO: 190). In other embodiments, the caTCR and the CSR can be encoded in two different nucleic acids, expressed, and separately translated separate polypeptides.

Construct Combinations Comprising Trispecific Constructs

In some embodiments, the construct combination comprises at least one trispecific construct which specifically binds to three target ligands (such as cell surface antigens or peptide/MHC complexes) and is capable of stimulating an immune cell on the surface of which it is functionally expressed upon target ligand binding. In some embodiments, the trispecific construct combination specifically targets CD22, CD19, and CD20.

In some embodiments, the construct combination comprises a trispecific caTCR and a CSR, in which the caTCR has a sequence that has at least 90% (e.g., 92%, 94%, 96%, 98%, 99%, or 100%) identity to the sequence of SEQ ID NO: 24 and the CSR has a sequence that has at least 90% (e.g., 92%, 94%, 96%, 98%, 99%, or 100%) identity to the sequence of any one of SEQ ID NOS: 81-96.

In some embodiments, the construct combination comprises a trispecific caTCR and a CSR, in which the caTCR has a sequence that has at least 90% (e.g., 92%, 94%, 96%, 98%, 99%, or 100%) identity to the sequence of SEQ ID NO: 25 and the CSR has a sequence that has at least 90% (e.g., 92%, 94%, 96%, 98%, 99%, or 100%) identity to the sequence of any one of SEQ ID NOS: 81-96.

In some embodiments, the construct combination comprises a trispecific caTCR and a CSR, in which the caTCR has a sequence that has at least 90% (e.g., 92%, 94%, 96%, 98%, 99%, or 100%) identity to the sequence of SEQ ID NO: 26 and the CSR has a sequence that has at least 90%

(e.g., 92%, 94%, 96%, 98%, 99%, or 100%) identity to the sequence of any one of SEQ ID NOS: 81-96.

In some embodiments, the construct combination comprises a trispecific caTCR and a CSR, in which the caTCR has a sequence that has at least 90% (e.g., 92%, 94%, 96%, 98%, 99%, or 100%) identity to the sequence of SEQ ID NO: 27 and the CSR has a sequence that has at least 90% (e.g., 92%, 94%, 96%, 98%, 99%, or 100%) identity to the sequence of any one of SEQ ID NOS: 81-96.

In some embodiments, the construct combination comprises a trispecific caTCR and a CSR, in which the caTCR has a sequence that has at least 90% (e.g., 92%, 94%, 96%, 98%, 99%, or 100%) identity to the sequence of SEQ ID NO: 24 and the CSR has a sequence that has at least 90% (e.g., 92%, 94%, 96%, 98%, 99%, or 100%) identity to the sequence of any one of SEQ ID NOS: 97-112.

In some embodiments, the construct combination comprises a trispecific caTCR and a CSR, in which the caTCR has a sequence that has at least 90% (e.g., 92%, 94%, 96%, 98%, 99%, or 100%) identity to the sequence of SEQ ID NO: 25 and the CSR has a sequence that has at least 90% (e.g., 92%, 94%, 96%, 98%, 99%, or 100%) identity to the sequence of any one of SEQ ID NOS: 97-112.

In some embodiments, the construct combination comprises a trispecific caTCR and a CSR, in which the caTCR has a sequence that has at least 90% (e.g., 92%, 94%, 96%, 98%, 99%, or 100%) identity to the sequence of SEQ ID NO: 26 and the CSR has a sequence that has at least 90% (e.g., 92%, 94%, 96%, 98%, 99%, or 100%) identity to the sequence of any one of SEQ ID NOS: 97-112.

In some embodiments, the construct combination comprises a trispecific caTCR and a CSR, in which the caTCR has a sequence that has at least 90% (e.g., 92%, 94%, 96%, 98%, 99%, or 100%) identity to the sequence of SEQ ID NO: 27 and the CSR has a sequence that has at least 90% (e.g., 92%, 94%, 96%, 98%, 99%, or 100%) identity to the sequence of any one of SEQ ID NOS: 97-112.

In some embodiments, the construct combination comprises a trispecific caTCR and a CSR, in which the caTCR has a sequence that has at least 90% (e.g., 92%, 94%, 96%, 98%, 99%, or 100%) identity to the sequence of SEQ ID NO: 24 and the CSR has a sequence that has at least 90% (e.g., 92%, 94%, 96%, 98%, 99%, or 100%) identity to the sequence of any one of SEQ ID NOS: 113-128.

In some embodiments, the construct combination comprises a trispecific caTCR and a CSR, in which the caTCR has a sequence that has at least 90% (e.g., 92%, 94%, 96%, 98%, 99%, or 100%) identity to the sequence of SEQ ID NO: 25 and the CSR has a sequence that has at least 90% (e.g., 92%, 94%, 96%, 98%, 99%, or 100%) identity to the sequence of any one of SEQ ID NOS: 113-128.

In some embodiments, the construct combination comprises a trispecific caTCR and a CSR, in which the caTCR has a sequence that has at least 90% (e.g., 92%, 94%, 96%, 98%, 99%, or 100%) identity to the sequence of SEQ ID NO: 26 and the CSR has a sequence that has at least 90% (e.g., 92%, 94%, 96%, 98%, 99%, or 100%) identity to the sequence of any one of SEQ ID NOS: 113-128.

In some embodiments, the construct combination comprises a trispecific caTCR and a CSR, in which the caTCR has a sequence that has at least 90% (e.g., 92%, 94%, 96%, 98%, 99%, or 100%) identity to the sequence of SEQ ID NO: 27 and the CSR has a sequence that has at least 90% (e.g., 92%, 94%, 96%, 98%, 99%, or 100%) identity to the sequence of any one of SEQ ID NOS: 113-128.

In any one of the construct combinations comprising a trispecific caTCR and a CSR disclosed herein, in some embodiments, each caTCR and CSR can be encoded by a single nucleic acid, expressed, and translated as a single polypeptide initially, and then get cleaved into separate polypeptides. The caTCR and the CSR can be connected via a cleavable P2A peptide (e.g., SEQ ID NO: 190). In other embodiments, the caTCR and the CSR can be encoded in two different nucleic acids, expressed, and separately translated separate polypeptides.

In some embodiments, a caTCR, when associated with CD3ζ upon binding target antigen, can activate T cells. A CSR generally does not associate with CD3ζ and does not activate T cells upon binding target antigen. Additional description and examples of caTCRs and CSRs can be found in International Patent Publication Nos. WO2018/200582 and WO2018/200583, each of which is incorporated herein by reference in its entirety.

Antibody Drug Conjugates

In some embodiments, there is provided an anti-CD22 immunoconjugate comprising an anti-CD22 antibody moiety and a therapeutic agent (also referred to herein as an "antibody-drug conjugate", or "ADC"). In some embodiments, the therapeutic agent is a toxin that is either cytotoxic, cytostatic, or otherwise prevents or reduces the ability of the target cells to divide. The use of ADCs for the local delivery of cytotoxic or cytostatic agents, i.e., drugs to kill or inhibit tumor cells in the treatment of cancer (Syrigos and Epenetos, *Anticancer Research* 19: 605-614 (1999); Niculescu-Duvaz and Springer, *Adv. Drg. Del. Rev.* 26: 151-172 (1997); U.S. Pat. No. 4,975,278) allows targeted delivery of the drug moiety to target cells, and intracellular accumulation therein, where systemic administration of these unconjugated therapeutic agents may result in unacceptable levels of toxicity to normal cells as well as the target cells sought to be eliminated (Baldwin et al., *Lancet* (Mar. 15, 1986): 603-605 (1986); Thorpe, (1985) "Antibody Carriers Of Cytotoxic Agents In Cancer Therapy: A Review," in Monoclonal Antibodies '84: Biological And Clinical Applications, A. Pinchera et al. (eds.), pp. 475-506). Maximal efficacy with minimal toxicity is sought thereby.

Therapeutic agents used in anti-CD22 immunoconjugates (e.g., an anti-CD22 ADC) include, for example, daunomycin, doxorubicin, methotrexate, and vindesine (Rowland et al., *Cancer Immunol. Immunother.* 21: 183-187 (1986)). Toxins used in anti-CD22 immunoconjugates include bacterial toxins such as diphtheria toxin, plant toxins such as ricin, small molecule toxins such as geldanamycin (Mandler et al., *J. Nat. Cancer Inst.* 92(19): 1573-1581 (2000); Mandler et al., Bioorganic & Med. Chem. Letters 10: 1025-1028 (2000); Mandler et al., *Bioconjugate Chem.* 13: 786-791 (2002)), maytansinoids (EP 1391213; Liu et al., *Proc. Natl. Acad. Sci. USA* 93: 8618-8623 (1996)), and calicheamicin (Lode et al., *Cancer Res.* 58: 2928 (1998); Hinman et al., *Cancer Res.* 53: 3336-3342 (1993)). The toxins may exert their cytotoxic and cytostatic effects by mechanisms including tubulin binding, DNA binding, or topoisomerase inhibition. Some cytotoxic drugs tend to be inactive or less active when conjugated to large antibodies or protein receptor ligands.

Enzymatically active toxins and fragments thereof that can be used include, for example, diphtheria A chain, nonbinding active fragments of diphtheria toxin, exotoxin A chain (from Pseudomonas aeruginosa), ricin A chain, abrin A chain, modeccin A chain, α-sarcin, Aleurites fordii proteins, dianthin proteins, Phytolaca americana proteins (PAPI, PAPII, and PAP-S), *Momordica charantia* inhibitor, curcin, crotin, *Sapaonaria officinalis* inhibitor, gelonin, mitogellin, restrictocin, phenomycin, enomycin, and the tricothecenes. See, e.g., WO 93/21232 published Oct. 28, 1993.

Anti-CD22 immunoconjugates (e.g., an anti-CD22 ADC) of an anti-CD22 antibody moiety and one or more small molecule toxins, such as a calicheamicin, maytansinoids, dolastatins, aurostatins, a trichothecene, and CC1065, and the derivatives of these toxins that have toxin activity, are also contemplated herein.

In some embodiments, there is provided an anti-CD22 immunoconjugate (e.g., an anti-CD22 ADC) comprising a therapeutic agent that has an intracellular activity. In some embodiments, the anti-CD22 immunoconjugate is internalized and the therapeutic agent is a cytotoxin that blocks the protein synthesis of the cell, therein leading to cell death. In some embodiments, the therapeutic agent is a cytotoxin comprising a polypeptide having ribosome-inactivating activity including, for example, gelonin, bouganin, saporin, ricin, ricin A chain, bryodin, diphtheria toxin, restrictocin, Pseudomonas exotoxin A and variants thereof. In some embodiments, where the therapeutic agent is a cytotoxin comprising a polypeptide having a ribosome-inactivating activity, the anti-CD22 immunoconjugate must be internalized upon binding to the target cell in order for the protein to be cytotoxic to the cells.

In some embodiments, there is provided an anti-CD22 immunoconjugate (e.g., an anti-CD22 ADC) comprising a therapeutic agent that acts to disrupt DNA. In some embodiments, the therapeutic agent that acts to disrupt DNA is, for example, selected from the group consisting of enediyne (e.g., calicheamicin and esperamicin) and non-enediyne small molecule agents (e.g., bleomycin, methidiumpropyl-EDTA-Fe(II)).

The present invention further contemplates an anti-CD22 immunoconjugate (e.g., an anti-CD22 ADC) formed between the anti-CD22 antibody moiety and a compound with nucleolytic activity (e.g., a ribonuclease or a DNA endonuclease such as a deoxyribonuclease; DNase).

In some embodiments, the anti-CD22 immunoconjugate comprises an agent that acts to disrupt tubulin. Such agents may include, for example, rhizoxin/maytansine, paclitaxel, vincristine and vinblastine, colchicine, auristatin dolastatin 10 MMAE, and peloruside A.

In some embodiments, the anti-CD22 immunoconjugate (e.g., an anti-CD22 ADC) comprises an alkylating agent including, for example, Asaley NSC 167780, AZQ NSC 182986, BCNU NSC 409962, Busulfan NSC 750, carboxyphthalatoplatinum NSC 271674, CBDCA NSC 241240, CCNU NSC 79037, CHIP NSC 256927, chlorambucil NSC 3088, chlorozotocin NSC 178248, cis-platinum NSC 119875, clomesone NSC 338947, cyanomorpholino-doxorubicin NSC 357704, cyclodisone NSC 348948, dianhydrogalactitol NSC 132313, fluorodopan NSC 73754, hepsulfam NSC 329680, hycanthone NSC 142982, melphalan NSC 8806, methyl CCNU NSC 95441, mitomycin C NSC 26980, mitozolamide NSC 353451, nitrogen mustard NSC 762, PCNU NSC 95466, piperazine NSC 344007, piperazinedione NSC 135758, pipobroman NSC 25154, porfiromycin NSC 56410, spirohydantoin mustard NSC 172112, teroxirone NSC 296934, tetraplatin NSC 363812, thio-tepa NSC 6396, triethylenemelamine NSC 9706, uracil nitrogen mustard NSC 34462, and Yoshi-864 NSC 102627.

In some embodiments, the anti-CD22 immunoconjugate (e.g., an anti-CD22 ADC) comprises a highly radioactive atom. A variety of radioactive isotopes are available for the production of radioconjugated antibodies. Examples include 211At, 131I, 125I, 90Y, 186Re, 188Re, 153Sm, 212Bi, 32P, 212Pb and radioactive isotopes of Lu.

In some embodiments, the anti-CD22 antibody moiety can be conjugated to a "receptor" (such as streptavidin) for utilization in tumor pre-targeting wherein the antibody-receptor conjugate is administered to the patient, followed by removal of unbound conjugate from the circulation using a clearing agent and then administration of a "ligand" (e.g., avidin) that is conjugated to a cytotoxic agent (e.g., a radionucleotide).

In some embodiments, an anti-CD22 immunoconjugate (e.g., an anti-CD22 ADC) may comprise an anti-CD22 antibody moiety conjugated to a prodrug-activating enzyme. In some such embodiments, a prodrug-activating enzyme converts a prodrug to an active drug, such as an anti-viral drug. Such anti-CD22 immunoconjugates are useful, in some embodiments, in antibody-dependent enzyme-mediated prodrug therapy ("ADEPT"). Enzymes that may be conjugated to an antibody include, but are not limited to, alkaline phosphatases, which are useful for converting phosphate-containing prodrugs into free drugs; arylsulfatases, which are useful for converting sulfate-containing prodrugs into free drugs; proteases, such as serratia protease, thermolysin, subtilisin, carboxypeptidases and cathepsins (such as cathepsins B and L), which are useful for converting peptide-containing prodrugs into free drugs; D-alanylcarboxypeptidases, which are useful for converting prodrugs that contain D-amino acid substituents; carbohydrate-cleaving enzymes such as β-galactosidase and neuraminidase, which are useful for converting glycosylated prodrugs into free drugs; β-lactamase, which is useful for converting drugs derivatized with β-lactams into free drugs; and penicillin amidases, such as penicillin V amidase and penicillin G amidase, which are useful for converting drugs derivatized at their amine nitrogens with phenoxyacetyl or phenylacetyl groups, respectively, into free drugs. In some embodiments, enzymes may be covalently bound to antibody moieties by recombinant DNA techniques well known in the art. See, e.g., Neuberger et al., Nature 312: 604-608 (1984).

In some embodiments, the therapeutic portion of the anti-CD22 immunoconjugates (e.g., an anti-CD22 ADC) may be a nucleic acid. Nucleic acids that may be used include, but are not limited to, anti-sense RNA, genes or other polynucleotides, including nucleic acid analogs such as thioguanine and thiopurine.

The present application further provides anti-CD22 immunoconjugates (e.g., an anti-CD22 ADC) comprising an anti-CD22 antibody moiety attached to an effector molecule, wherein the effector molecule is a label, which can generate a detectable signal, indirectly or directly. These anti-CD22 immunoconjugates can be used for research or diagnostic applications, such as for the in vivo detection of cancer. The label is preferably capable of producing, either directly or indirectly, a detectable signal. For example, the label may be radio-opaque or a radioisotope, such as 3H, 14C, 32P, 35S, 123I, 125I, 131I; a fluorescent (fluorophore) or chemiluminescent (chromophore) compound, such as fluorescein isothiocyanate, rhodamine or luciferin; an enzyme, such as alkaline phosphatase, β-galactosidase or horseradish peroxidase; an imaging agent; or a metal ion. In some embodiments, the label is a radioactive atom for scintigraphic studies, for example 99Tc or 123I, or a spin label for nuclear magnetic resonance (NMR) imaging (also known as magnetic resonance imaging, MRI), such as zirconium-89, iodine-123, iodine-131, indium-111, fluorine-19, carbon-13, nitrogen-15, oxygen-17, gadolinium, manganese or iron.

Zirconium-89 may be complexed to various metal chelating agents and conjugated to antibodies, e.g., for PET imaging (WO 2011/056983).

In some embodiments, the anti-CD22 immunoconjugate is detectable indirectly. For example, a secondary antibody that is specific for the anti-CD22 immunoconjugate and contains a detectable label can be used to detect the anti-CD22 immunoconjugate.

III. caTCR Plus CSR Immune Cells

The present invention provides an immune cell (such as a T cell) presenting on its surface a caTCR and a CSR according to any of the caTCRs and CSRs described herein (such an immune cell is also referred to herein as a "caTCR plus CSR immune cell"). In some embodiments, the immune cell comprises nucleic acid encoding the caTCR and CSR, wherein the caTCR and CSR are expressed from the nucleic acid and localized to the immune cell surface. In some embodiments, the immune cell is a T cell. In some embodiments, the immune cell is selected from the group consisting of a cytotoxic T cell, a helper T cell, a natural killer T cell, and a suppressor T cell. In some embodiments, the immune cell does not express the TCR subunits from which the TCR-TMs of the caTCR are derived. For example, in some embodiments, the immune cell is an $\alpha\beta$ T cell and the TCR-TMs of the introduced caTCR comprise sequences derived from TCR $\delta$ and $\alpha$ chains, or the T cell is a $\gamma\delta$ T cell and the TCR-TMs of the introduced caTCR comprise sequences derived from TCR $\alpha$ and $\beta$ chains. In some embodiments, the immune cell is modified to block or decrease the expression of one or both of the endogenous TCR subunits of the immune cell. For example, in some embodiments, the immune cell is an $\alpha\beta$ T cell modified to block or decrease the expression of the TCR $\alpha$ and/or $\beta$ chains or the immune cell is a $\gamma\delta$ T cell modified to block or decrease the expression of the TCR $\gamma$ and/or $\delta$ chains. Modifications of cells to disrupt gene expression include any such techniques known in the art, including for example RNA interference (e.g., siRNA, shRNA, miRNA), gene editing (e.g., CRISPR- or TALEN-based gene knockout), and the like.

For example, in some embodiments, there is provided an immune cell (such as a T cell) comprising nucleic acid encoding a caTCR according to any of the caTCRs described herein and a CSR according to any of the CSRs described herein, wherein the caTCR and CSR are expressed from the nucleic acid and localized to the immune cell surface. In some embodiments, the nucleic acid comprises a first caTCR nucleic acid sequence encoding a first caTCR polypeptide chain of the caTCR, a second caTCR nucleic acid sequence encoding a second caTCR polypeptide chain of the caTCR, and a CSR nucleic acid sequence encoding a CSR polypeptide chain of the CSR. In some embodiments, the first and second caTCR nucleic acid sequences and CSR nucleic acid sequence are each contained in different vectors. In some embodiments, some or all of the nucleic acid sequences are contained in the same vector. Vectors may be selected, for example, from the group consisting of mammalian expression vectors and viral vectors (such as those derived from retroviruses, adenoviruses, adeno-associated viruses, herpes viruses, and lentiviruses). In some embodiments, one or more of the vectors is integrated into the host genome of the immune cell. In some embodiments, the first and second caTCR nucleic acid sequences and CSR nucleic acid sequence are each under the control of different promoters. In some embodiments, some or all of the promoters have the same sequence. In some embodiments, some or all of the promoters have different sequences. In some embodiments, some or all of the nucleic acid sequences are under the control of a single promoter. In some embodiments, some or all of the promoters are inducible. In some embodiments, the immune cell is selected from the group consisting of a cytotoxic T cell, a helper T cell, a natural killer T cell, and a suppressor T cell.

Thus, in some embodiments, there is provided a caTCR plus CSR immune cell (such as a T cell) expressing on its surface a caTCR according to any of the caTCRs described herein and a CSR according to any of the CSRs described herein, wherein the caTCR plus CSR immune cell comprises a) a first caTCR nucleic acid sequence encoding a first caTCR polypeptide chain of the caTCR; b) a second caTCR nucleic acid sequence encoding a second caTCR polypeptide chain of the caTCR; and c) a CSR nucleic acid sequence encoding a CSR polypeptide chain of the CSR, wherein the first and second caTCR polypeptide chains are expressed from the first and second caTCR nucleic acid sequences to form the caTCR, wherein the CSR polypeptide chain is expressed from the CSR nucleic acid to form the CSR, and wherein the caTCR and CSR localize to the surface of the immune cell. In some embodiments, the first caTCR nucleic acid sequence is contained in a first vector (such as a lentiviral vector), the second caTCR nucleic acid sequence is contained in a second vector (such as a lentiviral vector), and the CSR nucleic acid sequence is contained in a third vector (such as a lentiviral vector). In some embodiments, some or all of the first and second caTCR nucleic acid sequences and CSR nucleic acid sequence are contained in the same vector (such as a lentiviral vector). In some embodiments, each of the first and second caTCR nucleic acid sequences and CSR nucleic acid sequence are, individually, operably linked to a promoter. In some embodiments, some or all of the nucleic acid sequences are under the control of a single promoter. In some embodiments, some or all of the promoters have the same sequence. In some embodiments, some or all of the promoters have different sequences. In some embodiments, some or all of the promoters are inducible. In some embodiments, some or all of the vectors are viral vectors (such as lentiviral vectors). In some embodiments, the immune cell does not express the TCR subunits from which the TCR-TMs of the caTCR are derived. For example, in some embodiments, the immune cell is an $\alpha\beta$ T cell and the TCR-TMs of the introduced caTCR comprise sequences derived from TCR $\delta$ and $\gamma$ chains, or the immune cell is a $\gamma\delta$ T cell and the TCR-TMs of the introduced caTCR comprise sequences derived from TCR $\alpha$ and $\beta0$ chains. In some embodiments, the immune cell is modified to block or decrease the expression of one or both of its endogenous TCR subunits. For example, in some embodiments, the immune cell is an $\alpha\beta$ T cell modified to block or decrease the expression of the TCR $\alpha$ and/or $\beta$ chains, or the immune cell is a $\gamma\delta$ T cell modified to block or decrease the expression of the TCR $\alpha$ and/or $\beta$ chains. In some embodiments, the immune cell is selected from the group consisting of a cytotoxic T cell, a helper T cell, a natural killer T cell, and a suppressor T cell. In some embodiments, some or all of the vectors are viral vectors (such as lentiviral vectors) integrated into the host genome of the immune cell.

In some embodiments, there is provided a caTCR plus CSR immune cell (such as a T cell) expressing on its surface a caTCR according to any of the caTCRs described herein and a CSR according to any of the CSRs described herein, wherein the caTCR plus CSR immune cell comprises a) a first vector comprising a first promoter operably linked to a first caTCR nucleic acid sequence encoding a first caTCR polypeptide chain of the caTCR; b) a second vector comprising a second promoter operably linked to a second caTCR nucleic acid sequence encoding a second caTCR polypeptide chain of the caTCR; and c) a third vector comprising a third promoter operably linked to a CSR nucleic acid sequence encoding a CSR polypeptide chain of the CSR, wherein the first and second caTCR polypeptide chains are expressed from the first and second caTCR nucleic acid sequences to form the caTCR and the CSR polypeptide chain is expressed from the CSR nucleic acid sequence to form the CSR, and wherein the caTCR and CSR localize to the surface of the immune cell. In some embodiments, some or all of the promoters have the same sequence. In some embodiments, some or all of the promoters have different sequences. In some embodiments, some or all of the promoters are inducible. In some embodiments, the immune cell does not express the TCR subunits from which the TCR-TMs of the caTCR are derived. For example, in some embodiments, the immune cell is an αβ T cell and the TCR-TMs of the introduced caTCR comprise sequences derived from TCR δ and γ chains, or the immune cell is a γδ T cell and the TCR-TMs of the introduced caTCR comprise sequences derived from TCR α and β chains. In some embodiments, the immune cell is modified to block or decrease the expression of one or both of its endogenous TCR subunits. For example, in some embodiments, the immune cell is an αβ T cell modified to block or decrease the expression of the TCR α and/or β chains, or the immune cell is a γδ T cell modified to block or decrease the expression of the TCR γ and/or δ chains. In some embodiments, the immune cell is selected from the group consisting of a cytotoxic T cell, a helper T cell, a natural killer T cell, and a suppressor T cell. In some embodiments, the first and second vectors are viral vectors (such as lentiviral vectors) integrated into the host genome of the immune cell.

In some embodiments, there is provided a caTCR plus CSR immune cell (such as a T cell) expressing on its surface a caTCR according to any of the caTCRs described herein and a CSR according to any of the CSRs described herein, wherein the caTCR plus CSR immune cell comprises a) a first vector comprising i) a first promoter operably linked to a first caTCR nucleic acid sequence encoding a first caTCR polypeptide chain of the caTCR and ii) a second promoter operably linked to a second caTCR nucleic acid sequence encoding a second caTCR polypeptide chain of the caTCR; and b) a second vector comprising a third promoter operably linked to a CSR nucleic acid sequence encoding a CSR polypeptide chain of the CSR, wherein the first and second caTCR polypeptide chains are expressed from the first and second caTCR nucleic acid sequences to form the caTCR and the CSR polypeptide chain is expressed from the CSR nucleic acid sequence to form the CSR, and wherein the caTCR localizes to the surface of the immune cell. In some embodiments, some or all of the promoters have the same sequence. In some embodiments, some or all of the promoters have different sequences. In some embodiments, some or all of the promoters are inducible. In some embodiments, the immune cell does not express the TCR subunits from which the TCR-TMs of the caTCR are derived. For example, in some embodiments, the immune cell is an αβ T cell and the TCR-TMs of the introduced caTCR comprise sequences derived from TCR δ and γ chains, or the immune cell is a γδ T cell and the TCR-TMs of the introduced caTCR comprise sequences derived from TCR α and β chains. In some embodiments, the immune cell is modified to block or decrease the expression of one or both of its endogenous TCR subunits. For example, in some embodiments, the immune cell is an αβ T cell modified to block or decrease the expression of the TCR α and/or β chains, or the immune cell is a γδ T cell modified to block or decrease the expression of the TCR α and/or δ chains. In some embodiments, the immune cell is selected from the group consisting of a cytotoxic T cell, a helper T cell, a natural killer T cell, and a suppressor T cell. In some embodiments, the first and second vectors are viral vectors (such as lentiviral vectors) integrated into the host genome of the immune cell. It is to be appreciated that embodiments where any of the nucleic acid sequences are swapped are also contemplated, such as where the first or second caTCR nucleic acid sequence is swapped with the CSR nucleic acid sequence.

In some embodiments, there is provided a caTCR plus CSR immune cell (such as a T cell) expressing on its surface a caTCR according to any of the caTCRs described herein and a CSR according to any of the CSRs described herein, wherein the caTCR plus CSR immune cell comprises a) a first vector comprising i) a first caTCR nucleic acid sequence encoding a first caTCR polypeptide chain of the caTCR and ii) a second caTCR nucleic acid sequence encoding a second caTCR polypeptide chain of the caTCR, wherein the first and second caTCR nucleic acid sequences are under the control of a first promoter; and b) a second vector comprising a second promoter operably linked to a CSR nucleic acid sequence encoding a CSR polypeptide chain of the CSR, wherein the first and second caTCR polypeptide chains are expressed from the first and second caTCR nucleic acid sequences to form the caTCR and the CSR polypeptide chain is expressed from the CSR nucleic acid sequence to form the CSR, and wherein the caTCR and CSR localize to the surface of the immune cell. In some embodiments, the first promoter is operably linked to the 5' end of the first caTCR nucleic acid sequence, and there is nucleic acid linker selected from the group consisting of an internal ribosomal entry site (IRES) and a nucleic acid encoding a self-cleaving 2A peptide (such as P2A, T2A, E2A, or F2A) linking the 3' end of first caTCR nucleic acid sequence to the 5' end of the second caTCR nucleic acid sequence, wherein the first caTCR nucleic acid sequence and the second caTCR nucleic acid sequence are transcribed as a single RNA under the control of the promoter. In some embodiments, the first promoter is operably linked to the 5' end of the second caTCR nucleic acid sequence, and there is nucleic acid linker selected from the group consisting of an internal ribosomal entry site (IRES) and a nucleic acid encoding a self-cleaving 2A peptide (such as P2A, T2A, E2A, or F2A) linking the 3' end of second caTCR nucleic acid sequence to the 5' end of the first caTCR nucleic acid sequence, wherein the first caTCR nucleic acid sequence and the second caTCR nucleic acid sequence are transcribed as a single RNA under the control of the promoter. In some embodiments, the first and/or second promoters have the same sequence. In some embodiments, the first and/or second promoters have different sequences. In some embodiments, the first and/or second promoters are inducible. In some embodiments, the immune cell does not express the TCR subunits from which the TCR-TMs of the caTCR are derived. For example, in some embodiments, the immune cell is an αβ T cell and the TCR-TMs of the introduced caTCR comprise sequences derived from TCR δ and γ chains, or the immune cell is a γδ T cell and the TCR-TMs of the introduced caTCR comprise sequences derived from TCR α and β0 chains. In some embodiments, the immune cell is modified to block or decrease the expression of one or both of its endogenous TCR subunits. For example, in some embodiments, the immune cell is an αβ T cell modified to block or decrease the expression of the TCR α and/or β chains, or the immune cell is a γδ T cell modified to block or decrease the expression of the TCR γ and/or δ chains. In some embodiments, the immune cell is selected from the group consisting of a cytotoxic T cell, a helper T cell, a natural killer T cell, and a suppressor T cell. In some embodiments, the vector is a viral vector (such as a lentiviral vector) integrated into the host genome of the immune cell. It is to be appreciated that embodiments where any of the nucleic acid sequences are swapped are also contemplated, such as where the first or second caTCR nucleic acid sequence is swapped with the CSR nucleic acid sequence.

In some embodiments, there is provided a caTCR plus CSR immune cell (such as a T cell) expressing on its surface a caTCR according to any of the caTCRs described herein and a CSR according to any of the CSRs described herein, wherein the caTCR plus CSR immune cell comprises a vector comprising a) a first caTCR nucleic acid sequence encoding a first caTCR polypeptide chain of the caTCR; b) a second caTCR nucleic acid sequence encoding a second caTCR polypeptide chain of the caTCR; and c) a CSR nucleic acid sequence encoding a CSR polypeptide chain of the CSR, wherein the first and second caTCR nucleic acid sequences and the CSR nucleic acid sequence are under the control of a single promoter; wherein the first and second caTCR polypeptide chains are expressed from the first and second caTCR nucleic acid sequences to form the caTCR and the CSR polypeptide chain is expressed from the CSR nucleic acid sequence to form the CSR, and wherein the caTCR and CSR localize to the surface of the immune cell. In some embodiments, the promoter is operably linked to one of the nucleic acid sequences, which is linked to the other nucleic acid sequences by nucleic acid linkers selected, individually, from the group consisting of an internal ribosomal entry site (IRES) and a nucleic acid encoding a self-cleaving 2A peptide (such as P2A, T2A, E2A, or F2A), such that the first and second caTCR nucleic acid sequences and the CSR nucleic acid sequence are transcribed as a single RNA under the control of the promoter. In some embodiments, the promoter is inducible. In some embodiments, the immune cell does not express the TCR subunits from which the TCR-TMs of the caTCR are derived. For example, in some embodiments, the immune cell is an αβ T cell and the TCR-TMs of the introduced caTCR comprise sequences derived from TCR δ and γ chains, or the immune cell is a γδ T cell and the TCR-TMs of the introduced caTCR comprise sequences derived from TCR α and β0 chains. In some embodiments, the immune cell is modified to block or decrease the expression of one or both of its endogenous TCR subunits. For example, in some embodiments, the immune cell is an αβ T cell modified to block or decrease the expression of the TCR α and/or β chains, or the immune cell is a γδ T cell modified to block or decrease the expression of the TCR γ and/or β chains. In some embodiments, the immune cell is selected from the group consisting of a cytotoxic T cell, a helper T cell, a natural killer T cell, and a suppressor T cell. In some embodiments, the vector is a viral vector (such as a lentiviral vector) integrated into the host genome of the immune cell.

IV. Fc Variants

In some embodiments, anti-CD22 constructs described herein may comprise a variant Fc region, wherein the variant Fc region may comprise at least one amino acid modification relative to a reference Fc region (or parental Fc region or a wild-type Fc region). Amino acid modifications may be made in an Fc region to alter effector function and/or to increase serum stability of the construct. Construct comprising variant Fc regions may demonstrate an altered affinity for an Fc receptor (e.g., an FcγR), provided that the variant Fc regions do not have a substitution at positions that make a direct contact with Fc receptor based on crystallographic and structural analysis of Fc-Fc receptor interactions such as those disclosed by Sondermann et al., 2000, Nature, 406: 267-273. Examples of positions within the Fc region that make a direct contact with an Fc receptor such as an FcγR are amino acids 234-239 (hinge region), amino acids 265-269 (B/C loop), amino acids 297-299 (C'/E loop), and amino acids 327-332 (F/G) loop. In some embodiments, constructs comprising variant Fc regions may comprise a modification of at least one residue that makes a direct contact with an FcγR based on structural and crystallographic analysis.

Amino acid modifications in Fc regions to create variant Fc regions that, e.g., alter affinity for activating and/or inhibitory receptors, lead to improved effector function such as, e.g., Antibody-Dependent Cell-Mediated Cytotoxicity (ADCC) and Complement Dependent Cytotoxicity (CDC), increase binding affinity for C1q, reduce or eliminate FcR binding, increase half-life are known in the art (see, e.g., U.S. Pat. Nos. 9,051,373, 9,040,041, 8,937,158, 8,883,973, 8,883,147, 8,858,937, 8,852,586, 8,809,503, 8,802,823, 8,802,820, 8,795,661, 8,753,629, 8,753,628, 8,735,547, 8,735,545, 8,734,791, 8,697,396, 8,546,543, 8,475,792, 8,399,618, 8,394,925, 8,388,955, 8,383,109, 8,367,805, 8,362,210, 8,338,574, 8,324,351, 8,318,907, 8,188,231, 8,124,731, 8,101,720, 8,093,359, 8,093,357, 8,088,376, 8,084,582, 8,039,592, 8,012,476, 7,799,900, 7,790,858, 7,785,791, 7,741,072, 7,704,497, 7,662,925, 7,416,727, 7,371,826, 7,364,731, 7,335,742, 7,332,581, 7,317,091, 7,297,775, 7,122,637, 7,083,784, 6,737,056, 6,538,124, 6,528,624 and 6,194,551).

In some embodiments, a variant Fc region may have different glycosylation patterns as compared to a parent Fc region (e.g., aglycosylated). In some embodiments, different glycosylation patterns may arise from expression in different cell lines, e.g., an engineered cell line.

Constructs described herein may comprise variant Fc regions that bind with a greater affinity to one or more FcγRs. Such constructs preferably mediate effector function more effectively as discussed infra. In some embodiments, constructs described herein may comprise variant Fc regions that bind with a weaker affinity to one or more FcγRs. Reduction or elimination of effector function may be desirable in certain cases, for example, in the case of constructs whose mechanism of action involves blocking or antagonism but not killing of the cells bearing a target antigen. In some embodiments, increased effector function may be directed to tumor cells and cells expressing foreign antigens.

V. Construct Production

Provided constructs or portions thereof, or nucleic acids encoding them, may be produced by any available means. Methods for construct production are well-known in the art. Technologies for generating antibodies (e.g., scFv antibodies, monoclonal antibodies, and/or polyclonal antibodies) are available in the art. It will be appreciated that a wide range of animal species can be used for the production of antisera, e.g., mouse, rat, rabbit, pig, cow, deer, sheep, goat, cat, dog, monkey, and chicken. The choice of animal may be decided upon the ease of manipulation, costs or the desired amount of sera, as would be known to one of skill in the art. It will be appreciated that antibodies can also be produced transgenically through the generation of a mammal or plant that is transgenic for the immunoglobulin heavy and light chain sequences of interest (e.g., a transgenic rodent transgenic for human immunoglobulin heavy and light chain genes). In connection with the transgenic production in mammals, antibodies can be produced in, and recovered from, the milk of goats, cows, or other mammals (see, e.g., U.S. Pat. Nos. 5,827,690, 5,756,687, 5,750,172, and 5,741,957; herein incorporated by reference in their entireties). Alternatively, antibodies may be made in chickens, producing IgY molecules (Schade et al., 1996, *ALTEX* 13(5): 80-85).

In some embodiments, antibodies suitable for the present invention are subhuman primate antibodies. For example, general techniques for raising therapeutically useful antibodies in baboons may be found, for example, in International Patent Application Publication No. 1991/11465 and in Losman et al., 1990, *Int. J. Cancer* 46: 310. In some embodiments, antibodies (e.g., monoclonal antibodies) may be prepared using hybridoma methods (Milstein and Cuello, 1983, *Nature* 305(5934): 537-40). In some embodiments, antibodies (e.g., monoclonal antibodies) may also be made by recombinant methods (see, e.g., U.S. Pat. No. 4,166,452).

Many of the difficulties associated with generating antibodies by B-cell immortalization can be overcome by engineering and expressing construct components in *E. coli* or yeast using phage display. To ensure the recovery of high affinity antibodies a combinatorial immunoglobulin library must typically contain a large repertoire size. A typical strategy utilizes mRNA obtained from lymphocytes or spleen cells of immunized mice to synthesize cDNA using reverse transcriptase. The heavy and light chain genes are amplified separately by PCR and ligated into phage cloning vectors. Two different libraries may be produced, one containing the heavy chain genes and one containing the light chain genes. The libraries can be naïve or they can be semi-synthetic, i.e., with all amino acids (with the exception of cysteine) equally likely to be present at any given position in a CDR. Phage DNA is isolated from each library, and the heavy and light chain sequences are ligated together and packaged to form a combinatorial library. Each phage contains a random pair of heavy and light chain cDNAs and upon infection of E. coli directs the expression of the polypeptides in an anti-CD22 construct in infected cells. To identify a construct that recognizes the antigen of interest (e.g., CD22), the phage library is plated, and the construct molecules present in the plaques are transferred to filters. The filters are incubated with radioactively labeled antigen and then washed to remove excess unbound ligand. A radioactive spot on the autoradiogram identifies a plaque that contains a construct that binds the antigen. Alternatively, identification of a construct that recognizes the antigen of interest (e.g., CD22) may be achieved by iterative binding of phage to the antigen, which is bound to a solid support, for example, beads or mammalian cells followed by removal of non-bound phage and by elution of specifically bound phage. In such embodiments, antigens are first biotinylated for immobilization to, for example, streptavidin-conjugated Dynabeads M-280. The phage library is incubated with the cells, beads or other solid support and non-binding phage is removed by washing. Construct phage clones that bind the antigen of interest are selected and tested for further characterization.

Once selected, positive clones may be tested for their binding to the antigen of interest expressed on the surface of live cells by flow cytometry. Briefly, phage clones may be incubated with cells (e.g., engineered to express the antigen of interest, or those that naturally express the antigen) that either do or do not express the antigen. The cells may be washed and then labeled with a mouse anti-M13 coat protein monoclonal antibody. Cells may be washed again and labeled with a fluorescent-conjugated secondary antibody (e.g., FITC-goat (Fab)$_2$ anti-mouse IgG) prior to flow cytometry. Cloning and expression vectors that are useful for producing a human immunoglobulin phage library can be obtained, for example, from Stratagene Cloning Systems (La Jolla, CA).

A similar strategy may be employed to obtain high-affinity scFv clones. A library with a large repertoire may be constructed by isolating V-genes from non-immunized human donors using PCR primers corresponding to all known $V_H$, Vκ and Vζ gene families. Following amplification, the Vκ and Vζ pools may be combined to form one pool. These fragments may be ligated into a phagemid vector. An scFv linker (e.g., $(G_4S)n$) may be ligated into the phagemid upstream of the $V_L$ fragment (or upstream of the $V_H$ fragment as so desired). The $V_H$ and linker-$V_L$ fragments (or $V_L$ and linker-$V_H$ fragments) may be amplified and assembled on the $J_H$ region. The resulting $V_H$-linker-$V_L$ (or $V_L$-linker-$V_H$) fragments may be ligated into a phagemid vector. The phagemid library may be panned using filters, as described above, or using immunotubes (Nunc; Maxisorp). Similar results may be achieved by constructing a combinatorial immunoglobulin library from lymphocytes or spleen cells of immunized rabbits and by expressing the scFv constructs in *P. pastoris* (see, e.g., Ridder et al., 1995, *Biotechnology*, 13: 255-260). Additionally, following isolation of appropriate scFv antibodies, higher binding affinities and slower dissociation rates may be obtained through affinity maturation processes such as mutagenesis and chain-shuffling (see, e.g., Jackson et al., 1998, *Br. J. Cancer*, 78: 181-188); Osbourn et al., 1996, *Immunotechnology*, 2: 181-196).

Human antibodies may be produced using various techniques, i.e., introducing human Ig genes into transgenic animals in which the endogenous Ig genes have been partially or completely inactivated can be exploited to synthesize human antibodies. In some embodiments, anti-CD22 human antibodies may be made by immunization of non-human animals engineered to make human antibodies in response to antigen challenge with human CD22.

Provided constructs may be also produced, for example, by utilizing a host cell system engineered to express an construct-encoding nucleic acid. Alternatively or additionally, provided constructs may be partially or fully prepared by chemical synthesis (e.g., using an automated peptide synthesizer or gene synthesis of construct-encoding nucleic acids). Constructs described herein may be expressed using any appropriate vector or expression cassette. A variety of vectors (e.g., viral vectors) and expression cassettes are known in the art and cells into which such vectors or expression cassettes may be introduced may be cultured as known in the art (e.g., using continuous or fed-batch culture systems). In some embodiments, cells may be genetically engineered; technologies for genetically engineering cells to express engineered polypeptides are well known in the art (see, e.g., Ausabel et al., eds., 1990, *Current Protocols in Molecular Biology* (Wiley, N.Y.)).

Constructs described herein may be purified, i.e., using filtration, centrifugation, and/or a variety of chromatographic technologies such as HPLC or affinity chromatography. In some embodiments, fragments of provided constructs are obtained by methods that include digestion with enzymes, such as pepsin or papain, and/or by cleavage of disulfide bonds by chemical reduction.

It will be appreciated that provided constructs may be engineered, produced, and/or purified in such a way as to improve characteristics and/or activity of the constructs. For example, improved characteristics include, but are not limited to, increased stability, improved binding affinity and/or avidity, increased binding specificity, increased production, decreased aggregation, decreased nonspecific binding, among others. In some embodiments, provided constructs may comprise one or more amino acid substitutions (e.g., in a framework region in the context of an immunoglobulin or fragment thereof (e.g., an scFv antibody)) that improve protein stability, antigen binding, expression level, or provides a site or location for conjugation of a therapeutic, diagnostic or detection agent.

VI. Therapeutic and Detection Agents

A therapeutic agent or a detection agent may be attached to an anti-CD22 construct described herein. Therapeutic agents may be any class of chemical entity including, for example, but not limited to, proteins, carbohydrates, lipids, nucleic acids, small organic molecules, non-biological polymers, metals, ions, radioisotopes, etc. In some embodiments, therapeutic agents for use in accordance with the present invention may have a biological activity relevant to the treatment of one or more symptoms or causes of cancer. In some embodiments, therapeutic agents for use in accordance with the present invention may have a biological activity relevant to modulation of the immune system and/or enhancement of T-cell mediated cytotoxicity. In some embodiments, therapeutic agents for use in accordance with the present invention have one or more other activities.

A detection agent may comprise any moiety that may be detected using an assay, for example due to its specific functional properties and/or chemical characteristics. Non-limiting examples of such agents include enzymes, radiolabels, haptens, fluorescent labels, phosphorescent molecules, chemiluminescent molecules, chromophores, luminescent molecules, photoaffinity molecules, colored particles or ligands, such as biotin.

Many detection agents are known in the art, as are systems for their attachment to constructs (see, for e.g., U.S. Pat. Nos. 5,021,236; 4,938,948; and 4,472,509). Examples of such detection agents include paramagnetic ions, radioactive isotopes, fluorochromes, NMR-detectable substances, X-ray imaging agents, among others. For example, in some embodiments, a paramagnetic ion is one or more of chromium (III), manganese (II), iron (III), iron (II), cobalt (II), nickel (II), copper (II), neodymium (III), samarium (III), ytterbium (III), gadolinium (III), vanadium (II), terbium (III), dysprosium (III), holmium (III), erbium (III), lanthanum (III), gold (III), lead (II), and/or bismuth (III).

The radioactive isotope may be one or more of actinium-225, astatine-211, bismuth-212, carbon-14, chromium-51, chlorine-36, cobalt-57, cobalt-58, copper-67, Europium-152, gallium-67, hydrogen-3, iodine-123, iodine-124, iodine-125, iodine-131, indium-111, iron-59, lead-212, lutetium-177, phosphorus-32, radium-223, radium-224, rhenium-186, rhenium-188, selenium-75, sulphur-35, technicium-99m, thorium-227, yttrium-90, and zirconium-89. Radioactively labeled constructs may be produced according to well-known technologies in the art.

A fluorescent label may be or may comprise one or more of Alexa 350, Alexa 430, AMCA, BODIPY 630/650, BODIPY 650/665, BODIPY-FL, BODIPY-R6G, BODIPY-TMR, BODIPY-TRX, Cascade Blue, Cy3, Cy5,6-FAM, Fluorescein Isothiocyanate, HEX, 6-JOE, Oregon Green 488, Oregon Green 500, Oregon Green 514, Pacific Blue, REG, Rhodamine Green, Rhodamine Red, Renographin, ROX, TAMRA, TET, Tetramethylrhodamine, and/or Texas Red, among others.

VII. Methods of Treatment

The anti-CD22 constructs and/or compositions of the invention can be administered to individuals (e.g., mammals such as humans) to treat a B-cell malignancy (e.g., a CD22$^+$ B-cell malignancy), such as a B-cell lymphoma or a B-cell leukemia. B-cell malginancies also include various types of cancers as described further herein. Examples of B-Cell malignancies include, without limitation, acute lymphoblastic leukemia (ALL), Hodgkin's lymphoma, non-Hodgkin's lymphoma, B cell chronic lymphocytic leukemia (CLL), multiple myeloma, follicular lymphoma, mantle cell lymphoma, pro-lymphocytic leukemia, hairy cell leukemia, common acute lymphocytic leukemia, and null-acute lymphoblastic leukemia. The present invention provides method of treating a B-cell malignancy (e.g., a CD22$^+$ B-cell malignancy) in an individual comprising administering to the individual an effective amount of a pharmaceutical composition comprising an anti-CD22 construct described herein (e.g., an anti-CD22 scFv), in which the anti-CD22 construct binds to an extracellular region of CD22 or a portion thereof (e.g., SEQ ID NO: 205 or a portion thereof).

Cancers

The anti-CD22 constructs and cells expressing anti-CD22 constructs including anti-CD22 CAR and anti-CD22 caTCR in some embodiments can be useful for treating B-cell related cancer. Cancers that may be treated using any of the methods described herein include tumors that are not vascularized, or not yet substantially vascularized, as well as vascularized tumors. The cancers may comprise non-solid tumors (such as hematological tumors, for example, leukemias and lymphomas) or may comprise solid tumors. Types of cancers to be treated with the anti-CD22 constructs and anti-CD22 CAR cells of the invention include, but are not limited to, carcinoma, blastoma, sarcoma, melanoma, neuroendocrine tumors, and glioma, and certain leukemia or lymphoid malignancies, benign and malignant tumors, and malignancies e.g., sarcomas, carcinomas, melanomas, and gliomas. Adult tumors/cancers and pediatric tumors/cancers are also included.

Solid tumors contemplated for treatment by any of the methods described herein include CNS tumors, such as glioma (e.g., brainstem glioma and mixed gliomas), glioblastoma (also known as glioblastoma multiforme), astrocytoma (such as high-grade astrocytoma), pediatric glioma or glioblastoma (such as pediatric high-grade glioma (HGG) and diffuse intrinsic pontine glioma (DIPG)), CNS lymphoma, germinoma, medulloblastoma, Schwannoma craniopharyogioma, ependymoma, pinealoma, hemangioblastoma, acoustic neuroma, oligodendroglioma, menangioma, neuroblastoma, retinoblastoma and brain metastases.

In some embodiments, the B-cell related cancer is pediatric glioma. In some embodiments, the pediatric glioma is a low-grade glioma. In some embodiments, the pediatric glioma is a high-grade glioma (HGG). In some embodiments, the pediatric glioma is glioblastoma multiforme. In some embodiments, the pediatric glioma is diffuse intrinsic pontine glioma (DIPG). In some embodiments, the DIPG is grade II. In some embodiments, the DIPG is grade III. In some embodiments, the DIPG is grade IV.

Additional solid tumors contemplated for treatment include fibrosarcoma, myxosarcoma, liposarcoma, chondrosarcoma (such as clear-cell chondrosarcoma), chondroblastoma, osteosarcoma, and other sarcomas, synovioma, mesothelioma, Ewing's tumor, leiomyosarcoma, rhabdomyosarcoma, colon carcinoma, lymphoid malignancy, pancreatic cancer, breast cancer, lung cancers, ovarian cancer, prostate cancer, hepatocellular carcinoma, squamous cell carcinoma, basal cell carcinoma, adenocarcinoma, sweat gland carcinoma, medullary thyroid carcinoma, papillary thyroid carcinoma, pheochromocytomas sebaceous gland carcinoma, papillary carcinoma, papillary adenocarcinomas, medullary carcinoma, bronchogenic carcinoma, renal cell carcinoma, hepatoma, bile duct carcinoma, choriocarcinoma, Wilms' tumor, cervical cancer (e.g., cervical carcinoma and pre-invasive cervical dysplasia), cancer of the anus, anal canal, or anorectum, vaginal cancer, cancer of the vulva (e.g., squamous cell carcinoma, intraepithelial carcinoma, adenocarcinoma, and fibrosarcoma), penile cancer, oropharyngeal cancer, head cancers (e.g., squamous cell carcinoma), neck cancers (e.g., squamous cell carcinoma), testicular cancer (e.g., seminoma, teratoma, embryonal carcinoma, teratocarcinoma, choriocarcinoma, sarcoma, Leydig cell tumor, fibroma, fibroadenoma, adenomatoid tumors, and lipoma), bladder carcinoma, melanoma, cancer of the uterus (e.g., endometrial carcinoma), and urothelial cancers (e.g., squamous cell carcinoma, transitional cell carcinoma, adenocarcinoma, ureter cancer, and urinary bladder cancer).

Hematologic cancers contemplated for treatment by any of the methods described herein include leukemias, including acute leukemias (such as acute lymphocytic leukemia, acute myelocytic leukemia, acute myelogenous leukemia and myeloblastic, promyelocytic, myelomonocytic, monocytic and erythroleukemia), chronic leukemias (such as chronic myelocytic (granulocytic) leukemia, chronic myelogenous leukemia, and chronic lymphocytic leukemia), polycythemia vera, lymphoma, Hodgkin's disease, non-Hodgkin's lymphoma (indolent and high grade forms), multiple myeloma, Waldenstrom's macroglobulinemia, heavy chain disease, myelodysplastic syndrome, hairy cell leukemia and myelodysplasia.

Cancer treatments can be evaluated, for example, by tumor regression, tumor weight or size shrinkage, time to progression, duration of survival, progression free survival, overall response rate, duration of response, quality of life, protein expression and/or activity. Approaches to determining efficacy of the therapy can be employed, including for example, measurement of response through radiological imaging.

In some embodiments, the anti-CD22 construct used in methods of treating a B-cell malignancy (e.g., a CD22$^+$ B-cell malignancy) comprises an antibody moiety that comprises i) a light chain variable region comprising one or more of LC-CDR1, LC-CDR2, and LC-CDR3 having the sequences of SEQ ID NOS: 206-208, respectively, and ii) a heavy chain variable region comprising one or more of HC-CDR1, HC-CDR2, and HC-CDR3 having the sequences of SEQ ID NOS: 209-211, respectively. In some embodiments, the antibody moiety comprises LC-CDR1, LC-CDR2, LC-CDR3, HC-CDR1, HC-CDR2, and HC-CDR3 having the sequences of SEQ ID NOS: 206-211, respectively. In other embodiments, the anti-CD22 construct used in methods of treating a B-cell malignancy comprises an antibody moiety that comprises i) a light chain variable region having LC-CDR1, LC-CDR2, and LC-CDR3 of the sequences of SEQ ID NOS: 206-208, respectively, and a sequence that has at least 90% (e.g., at least 92%, 94%, 96%, 98%, or 99%) identity to the sequence of SEQ ID NO: 212, and ii) a heavy chain variable region having HC-CDR1, HC-CDR2, and HC-CDR3 of the sequences of SEQ ID NOS: 209-211, respectively, and a sequence that has at least 90% (e.g., at least 92%, 94%, 96%, 98%, or 99%) identity to the sequence of SEQ ID NO: 213, in which the light chain variable region and the heavy chain variable region are joined to each other via a linker. In some embodiments, the anti-CD22 construct is a full-length antibody. In some embodiments, the anti-CD22 construct is a multispecific antibody (e.g., a bispecific antibody). In some embodiments, the anti-CD22 construct is a CAR or caTCR. In some embodiments, the anti-CD22 construct is an immunoconjugate comprising the antibody moiety described above and an effector molecule. The effector molecule may be a therapeutic agent (e.g., a drug, a toxin, a radioisotope, a protein, a peptide, or a nucleic acid) or a label. In some embodiments, the therapeutic agent is a drug or a toxin. In some embodiments, the composition further comprises a cell (such as an effector cell) associated with the anti-CD22 construct.

In some embodiments, the anti-CD22 construct used in methods of treating a B-cell malignancy (e.g., a CD22$^+$ B-cell malignancy) comprises an antibody moiety that comprises i) a light chain variable region comprising one or more of LC-CDR1, LC-CDR2, and LC-CDR3 having the sequences of SEQ ID NOS: 214-216, respectively, and ii) a heavy chain variable region comprising one or more of HC-CDR1, HC-CDR2, and HC-CDR3 having the sequences of SEQ ID NOS: 209, 210, and 217, respectively. In some embodiments, the antibody moiety comprises LC-CDR1, LC-CDR2, LC-CDR3, HC-CDR1, HC-CDR2, and HC-CDR3 having the sequences of SEQ ID NOS: 214-216, 209, 210, and 217, respectively. In other embodiments, the anti-CD22 construct used in methods of treating a B-cell malignancy comprises an antibody moiety that comprises i) a light chain variable region having LC-CDR1, LC-CDR2, and LC-CDR3 of the sequences of SEQ ID NOS: 214-216, respectively, and a sequence that has at least 90% (e.g., at least 92%, 94%, 96%, 98%, or 99%) identity to the sequence of SEQ ID NO: 218, and ii) a heavy chain variable region having HC-CDR1, HC-CDR2, and HC-CDR3 of the sequences of SEQ ID NOS: 209, 210, and 217, respectively, and a sequence that has at least 90% (e.g., at least 92%, 94%, 96%, 98%, or 99%) identity to the sequence of SEQ ID NO: 219, in which the light chain variable region and the heavy chain variable region are joined to each other via a linker. In some embodiments, the anti-CD22 construct is a full-length antibody. In some embodiments, the anti-CD22 construct is a multispecific antibody (e.g., a bispecific antibody). In some embodiments, the anti-CD22 construct is a CAR or caTCR. In some embodiments, the anti-CD22 construct is an immunoconjugate comprising the antibody moiety described above and an effector molecule. The effector molecule may be a therapeutic agent (e.g., a drug, a toxin, a radioisotope, a protein, a peptide, or a nucleic acid) or a label. In some embodiments, the therapeutic agent is a drug or a toxin. In some embodiments, the composition further comprises a cell (such as an effector cell) associated with the anti-CD22 construct.

In some embodiments of any of the methods for treating a B-cell malignancy (e.g., a CD22$^+$ B-cell malignancy described above, the anti-CD22 construct is conjugated to a cell (such as an immune cell, e.g., a T cell) prior to being administered to the individual. Thus, for example, there is provided a method of treating a B-cell malignancy (e.g., a CD22$^+$ B-cell malignancy) in an individual comprising a) conjugating an anti-CD22 construct described herein or an antibody moiety thereof to a cell (such as an immune cell, e.g., a T cell) to form an anti-CD22 construct/cell conjugate, and b) administering to the individual an effective amount of a composition comprising the anti-CD22 construct/cell conjugate. In some embodiments, the cell is derived from the individual. In some embodiments, the cell is not derived from the individual. In some embodiments, the anti-CD22 construct is conjugated to the cell by covalent linkage to a molecule on the surface of the cell. In some embodiments, the anti-CD22 construct is conjugated to the cell by non-covalent linkage to a molecule on the surface of the cell. In some embodiments, the anti-CD22 construct is conjugated to the cell by insertion of a portion of the anti-CD22 construct into the outer membrane of the cell.

Treatments can be evaluated, for example, by tumor regression, tumor weight or size shrinkage, time to progression, duration of survival, progression free survival, overall response rate, duration of response, quality of life, protein expression and/or activity. Approaches to determining efficacy of the therapy can be employed, including for example, measurement of response through radiological imaging.

In some embodiments, the efficacy of treatment may be measured as the percentage tumor growth inhibition (% TGI), which may be calculated using the equation $100-(T/C \times 100)$, where T is the mean relative tumor volume of the treated tumor, and C is the mean relative tumor volume of a non-treated tumor. In some embodiments, the % TGI is about 2%, about 4%, about 6, about 8%, 10%, about 20%, about 30%, about 40%, about 50%, about 60%, about 70%, about 80%, about 90%, about 91%, about 92%, about 93%, about 94%, about 95%, or more than 95%.

VIII. Anti-CD22 Construct Effector Cell Therapy

The present application also provides methods of using an anti-CD22 construct (such as an anti-CD22 CAR, anti-CD22 caTCR, or anti-CD22 CSR) to redirect the specificity of an effector cell (such as a primary T cell) to a $CD22^+$ cell in a B-cell malignancy. Thus, the present invention also provides a method of stimulating an effector cell-mediated response (such as a T cell-mediated immune response) to a target cell population or tissue comprising $CD22^+$ cells in a mammal, comprising the step of administering to the mammal an effector cell (such as a T cell) that expresses an anti-CD22 CAR or anti-CD22 caTCR. In some embodiments, "stimulating" an immune cell refers to eliciting an effector cell-mediated response (such as a T cell-mediated immune response), which is different from activating an immune cell. In some embodiments, an anti-CD22 CSR can stimulate an immune cell (e.g., a T cell), but does not activate the immune cell.

Anti-CD22 construct effector cells (such as anti-CD22 CAR T cells or anti-CD22 caTCR T cells) expressing the anti-CD22 construct can be infused to a recipient in need thereof. The infused cell is able to kill $CD22^+$ cells in the recipient. In some embodiments, unlike antibody therapies, anti-CD22 construct effector cells (such as T cells) are able to replicate in vivo resulting in long-term persistence that can lead to sustained tumor control.

In some embodiments, the anti-CD22 construct effector cells are anti-CD22 CAR T cells or anti-CD22 caTCR T cells that can undergo robust in vivo T cell expansion and can persist for an extended amount of time. In some embodiments, the anti-CD22 CAR T cells or anti-CD22 caTCR T cells of the invention develop into specific memory T cells that can be reactivated to inhibit any additional tumor formation or growth.

The anti-CD22 construct T cells (such as anti-CD22 CAR T cells or anti-CD22 caTCR T cells) of the invention may also serve as a type of vaccine for ex vivo immunization and/or in vivo therapy in a mammal. In some embodiments, the mammal is a human.

With respect to ex vivo immunization, at least one of the following occurs in vitro prior to administering the cell into a mammal: i) expansion of the cells, ii) introducing a nucleic acid encoding an anti-CD22 CAR or anti-CD22 caTCR to the cells, and/or iii) cryopreservation of the cells. Ex vivo procedures are well-known in the art. Briefly, cells are isolated from a mammal (preferably a human) and genetically modified (i.e., transduced or transfected in vitro) with a vector expressing an anti-CD22 CAR or anti-CD22 caTCR disclosed herein. The anti-CD22 CAR cell or anti-CD22 caTCR cell can be administered to a mammalian recipient to provide a therapeutic benefit. The mammalian recipient may be a human and the anti-CD22 CAR or anti-CD22 caTCR cell can be autologous with respect to the recipient. Alternatively, the cells can be allogeneic, syngeneic or xenogeneic with respect to the recipient. The procedure for ex vivo expansion of hematopoietic stem and progenitor cells is described in U.S. Pat. No. 5,199,942, incorporated herein by reference, can be applied to the cells of the present invention. Other suitable methods are known in the art, therefore the present invention is not limited to any particular method of ex vivo expansion of the cells. Briefly, ex vivo culture and expansion of T cells comprises: (1) collecting T cells from peripheral blood mononuclear cells (PBMC); and (2) expanding such cells ex vivo. In addition to the cellular growth factors described in U.S. Pat. No. 5,199,942, other factors such as flt3-L, IL-1, IL-3 and c-kit ligand, can be used for culturing and expansion of the cells.

In addition to using a cell-based vaccine in terms of ex vivo immunization, the present invention also provides compositions and methods for in vivo immunization to elicit an immune response directed against an antigen in a patient. The anti-CD22 construct effector cells (such as anti-CD22 CAR T cells or anti-CD22 caTCR T cells) of the present invention may be administered either alone, or as a pharmaceutical composition in combination with diluents and/or with other components such as IL-2 or other cytokines or cell populations. Briefly, pharmaceutical compositions of the present invention may comprise anti-CD22 construct effector cells (such as T cells), in combination with one or more pharmaceutically or physiologically acceptable carriers, diluents or excipients. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. In some embodiments, anti-CD22 construct effector cell (such as T cell) compositions are formulated for administration by intravenous, intrathecal, intracranial, intracerebral, or intracerebroventricular route.

The precise amount of the anti-CD22 construct effector cell (such as anti-CD22 CAR T cell or anti-CD22 caTCR T cell) compositions of the present invention to be administered can be determined by a physician with consideration of individual differences in age, weight, tumor size, extent of infection or metastasis, and condition of the patient (subject). In some embodiments, a pharmaceutical composition comprising the anti-CD22 construct effector cells (such as T cells) is administered at a dosage of about $10^4$ to about $10^9$ cells/kg body weight, such any of about $10^4$ to about $10^5$, about $10^5$ to about $10^6$, about $10^6$ to about $10^7$, about $10^7$ to about $10^8$, or about $10^8$ to about $10^9$ cells/kg body weight, including all integer values within those ranges. Anti-CD22 construct effect cell (such as T cell) compositions may also be administered multiple times at these dosages. The cells can be administered by using infusion techniques that are commonly known in immunotherapy (see, e.g., Rosenberg et al., New Eng. J. of Med. 319:1676, 1988). The optimal dosage and treatment regimen for a particular patient can readily be determined by one skilled in the art of medicine by monitoring the patient for signs of disease and adjusting the treatment accordingly.

In some embodiments, it may be desired to administer activated anti-CD22 construct T cells (such as anti-CD22 CAR T cells or anti-CD22 caTCR T cells) to a subject and then subsequently redraw blood (or have an apheresis performed), activate T cells therefrom according to the present invention, and reinfuse the patient with these activated and expanded T cells. This process can be carried out multiple times every few weeks. In some embodiments, T cells can be activated from blood draws of from 10 cc to 400 cc. In some embodiments, T cells are activated from blood draws of 20 cc, 30 cc, 40 cc, 50 cc, 60 cc, 70 cc, 80 cc, 90 cc, or 100 cc.

The administration of the anti-CD22 construct effector cells (such as anti-CD22 CAR T cells or anti-CD22 caTCR T cells) may be carried out in any convenient manner, including by injection, ingestion, transfusion, implantation or transplantation. The compositions described herein may be administered to a patient subcutaneously, intradermally, intratumorally, intranodally, intramedullary, intramuscularly, intrathecally, intracranially, intracerebrally, intracerebroventricularly, by intravenous (i.v.) injection, or intraperitoneally. In some embodiments, the anti-CD22 construct effector cell (such as T cell) compositions of the present invention are administered to a patient by intradermal or subcutaneous injection. In some embodiments, the anti-CD22 construct effector cell (such as T cell) compositions of the present invention are administered by i.v. injection. In some embodiments, the anti-CD22 construct effector cell (such as T cell) compositions of the present invention are administered by intrathecal injection. In some embodiments, the anti-CD22 construct effector cell (such as T cell) compositions of the present invention are administered by intracranial injection. In some embodiments, the anti-CD22 construct effector cell (such as T cell) compositions of the present invention are administered by intracerebral injection. In some embodiments, the anti-CD22 construct effector cell (such as T cell) compositions of the present invention are administered by intracerebroventricular injection. The compositions of anti-CD22 construct effector cells (such as T cells) may be injected directly into a tumor, lymph node, or site of infection.

Thus, for example, in some embodiments, there is provided a method of treating a B-cell malignancy (e.g., a CD22$^+$ B-cell malignancy) in an individual comprising administering to the individual an effective amount of a composition comprising an effector cell (such as a T cell) expressing an anti-CD22 CAR comprising a) an extracellular domain comprising an anti-CD22 construct described herein or an antibody moiety thereof that specifically binds to an extracellular region of CD22 or a portion thereof (e.g., SEQ ID NO: 205 or a portion thereof), b) a transmembrane domain, and c) an intracellular signaling domain comprising a CD3ζ intracellular signaling sequence and a CD28 and/or 4-1BB intracellular signaling sequence. In some embodiments, the anti-CD22 antibody moiety comprises i) a light chain variable region comprising one or more of LC-CDR1, LC-CDR2, and LC-CDR3 having the sequences of SEQ ID NOS: 206-208, respectively, and ii) a heavy chain variable region comprising one or more of HC-CDR1, HC-CDR2, and HC-CDR3 having the sequences of SEQ ID NOS: 209-211, respectively. In some embodiments, the antibody moiety comprises LC-CDR1, LC-CDR2, LC-CDR3, HC-CDR1, HC-CDR2, and HC-CDR3 having the sequences of SEQ ID NOS: 206-211, respectively. In other embodiments, the anti-CD22 antibody moiety comprises i) a light chain variable region having LC-CDR1, LC-CDR2, and LC-CDR3 of the sequences of SEQ ID NOS: 206-208, respectively, and a sequence that has at least 90% (e.g., at least 92%, 94%, 96%, 98%, or 99%) identity to the sequence of SEQ ID NO: 212, and ii) a heavy chain variable region having HC-CDR1, HC-CDR2, and HC-CDR3 of the sequences of SEQ ID NOS: 209-211, respectively, and a sequence that has at least 90% (e.g., at least 92%, 94%, 96%, 98%, or 99%) identity to the sequence of SEQ ID NO: 213, in which the light chain variable region and the heavy chain variable region are joined to each other via a linker.

Thus, for example, in some embodiments, there is provided a method of treating a B-cell malignancy (e.g., a CD22$^+$ B-cell malignancy) in an individual comprising administering to the individual an effective amount of a composition comprising an effector cell (such as a T cell) expressing an anti-CD22 CAR comprising a) an extracellular domain comprising an anti-CD22 antibody moiety that specifically binds to an extracellular region of CD22 or a portion thereof (e.g., SEQ ID NO: 205 or a portion thereof), b) a transmembrane domain, and c) an intracellular signaling domain comprising a CD3 intracellular signaling sequence and a CD28 and/or 4-1BB intracellular signaling sequence. In some embodiments, the anti-CD22 antibody moiety comprises i) a light chain variable region comprising one or more of LC-CDR1, LC-CDR2, and LC-CDR3 having the sequences of SEQ ID NOS: 214-216, respectively, and ii) a heavy chain variable region comprising one or more of HC-CDR1, HC-CDR2, and HC-CDR3 having the sequences of SEQ ID NOS: 209, 210, and 217, respectively. In some embodiments, the antibody moiety comprises LC-CDR1, LC-CDR2, LC-CDR3, HC-CDR1, HC-CDR2, and HC-CDR3 having the sequences of SEQ ID NOS: 214-216, 209, 210, and 217, respectively. In other embodiments, the anti-CD22 antibody moiety comprises i) a light chain variable region having LC-CDR1, LC-CDR2, and LC-CDR3 of the sequences of SEQ ID NOS: 214-216, respectively, and a sequence that has at least 90% (e.g., at least 92%, 94%, 96%, 98%, or 99%) identity to the sequence of SEQ ID NO: 218, and ii) a heavy chain variable region having HC-CDR1, HC-CDR2, and HC-CDR3 of the sequences of SEQ ID NOS: 209, 210, and 217, respectively, and a sequence that has at least 90% (e.g., at least 92%, 94%, 96%, 98%, or 99%) identity to the sequence of SEQ ID NO: 219, in which the light chain variable region and the heavy chain variable region are joined to each other via a linker.

IX. Methods of Diagnosis and Imaging Using Anti-CD22 Constructs

Labeled anti-CD22 antibody moieties and derivatives and analogs thereof, which specifically bind to a CD22 on the surface of a cell, can be used for diagnostic purposes to detect, diagnose, or monitor a B-cell malignancy (e.g., a B-cell related cancer or a CD22$^+$ B-cell malignancy). For example, the anti-CD22 antibody moieties of the invention can be used in in situ, in vivo, ex vivo, and in vitro diagnostic assays or imaging assays.

Additional embodiments of the invention include methods of diagnosing a B-cell malignancy (e.g., a B-cell related cancer or a CD22$^+$ B-cell malignancy) in an individual (e.g., a mammal such as a human). The methods comprise detecting CD22-presenting cells in the individual. In some embodiments, the B-cell malignancy is a B-cell lymphoma or a B-cell leukemia. In some embodiments, there is provided a method of diagnosing a B-cell malignancy (e.g., a B-cell related cancer or a CD22$^+$ B-cell malignancy) in an individual (e.g., a mammal, such as a human) comprising (a)

administering an effective amount of a labeled anti-CD22 antibody moiety according to any of the embodiments described above to the individual; and (b) determining the level of the label in the individual, such that a level of the label above a threshold level indicates that the individual has the B-cell malignancy. The threshold level can be determined by various methods, including, for example, by detecting the label according to the method of diagnosing described above in a first set of individuals that have the B-cell malignancy and a second set of individuals that do not have the B-cell malignancy, and setting the threshold to a level that allows for discrimination between the first and second sets. In some embodiments, the threshold level is zero, and the method comprises determining the presence or absence of the label in the individual. In some embodiments, the method further comprises waiting for a time interval following the administering of step (a) to permit the labeled anti-CD22 antibody moiety to preferentially concentrate at sites in the individual where the CD22 is expressed (and for unbound labeled anti-CD22 antibody moiety to be cleared). In some embodiments, the method further comprises subtracting a background level of the label. Background level can be determined by various methods, including, for example, by detecting the label in the individual prior to administration of the labeled anti-CD22 antibody moiety, or by detecting the label according to the method of diagnosing described above in an individual that does not have the B-cell malignancy.

Anti-CD22 antibody moieties of the invention can be used to assay levels of CD22-presenting cell in a biological sample using methods known to those of skill in the art. Suitable antibody labels are known in the art and include enzyme labels, such as, glucose oxidase; radioisotopes, such as iodine (131I, 125I, 123I, 121I), carbon (14C), sulfur (35S), tritium (3H), indium (115mIn, 113mIn, 112In, 111In), technetium (99Tc, 99mTc), thallium (201Ti), gallium (68Ga, 67Ga), palladium (103Pd), molybdenum (99Mo), xenon (133Xe), fluorine (18F), samarium (153Sm), lutetium (177Lu), gadolinium (159Gd), promethium (149Pm), lanthanum (140La), ytterbium (175Yb), holmium (166Ho), yttrium (90Y), scandium (47Sc), rhenium (186Re, 188Re), praseodymium (142Pr), rhodium (105Rh), and ruthenium (97Ru); luminol; fluorescent labels, such as fluorescein and rhodamine; and biotin.

Techniques known in the art may be applied to labeled anti-CD22 antibody moieties of the invention. Such techniques include, but are not limited to, the use of bifunctional conjugating agents (see e.g., U.S. Pat. Nos. 5,756,065; 5,714,631; 5,696,239; 5,652,361; 5,505,931; 5,489,425; 5,435,990; 5,428,139; 5,342,604; 5,274,119; 4,994,560; and 5,808,003). Aside from the above assays, various in vivo and ex vivo assays are available to the skilled practitioner. For example, one can expose cells within the body of the subject to an anti-CD22 antibody moiety which is optionally labeled with a detectable label, e.g., a radioactive isotope, and binding of the anti-CD22 antibody moiety to the cells can be evaluated, e.g., by external scanning for radioactivity or by analyzing a sample (e.g., a biopsy or other biological sample) derived from a subject previously exposed to the anti-CD22 antibody moiety.

X. Pharmaceutical Compositions

Also provided herein are compositions (such as pharmaceutical compositions, also referred to herein as formulations) comprising an anti-CD22 construct described herein, a nucleic acid encoding one or more polypeptides contained in an anti-CD22 construct described herein, an expression cassette comprising the nucleic acid, or a host cell expressing an anti-CD22 construct. In some embodiments, the composition further comprises a cell (such as an effector cell, e.g., a T cell) associated with the anti-CD22 construct. In some embodiments, there is provided a pharmaceutical composition comprising an anti-CD22 construct and a pharmaceutically acceptable carrier. In some embodiments, the pharmaceutical composition further comprises a cell (such as an effector cell, e.g., a T cell) associated with the anti-CD22 construct.

Suitable formulations of the anti-CD22 constructs are obtained by mixing an anti-CD22 construct having the desired degree of purity with optional pharmaceutically acceptable carriers, excipients or stabilizers (Remington's Pharmaceutical Sciences 16th edition, Osol, A. Ed. (1980)), in the form of lyophilized formulations or aqueous solutions. Acceptable carriers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propylparaben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as olyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as TWEEN™, PLURONICS™ or polyethylene glycol (PEG). Exemplary formulations are described in WO98/56418, expressly incorporated herein by reference. Lyophilized formulations adapted for subcutaneous administration are described in WO97/04801. Such lyophilized formulations may be reconstituted with a suitable diluent to a high protein concentration and the reconstituted formulation may be administered subcutaneously to the individual to be treated herein. Lipofectins or liposomes can be used to deliver the anti-CD22 antibodies s of this invention into cells.

The formulation herein may also contain one or more active compounds in addition to the anti-CD22 construct as necessary for the particular indication being treated, preferably those with complementary activities that do not adversely affect each other. For example, it may be desirable to further provide an anti-neoplastic agent, a growth inhibitory agent, a cytotoxic agent, or a chemotherapeutic agent in addition to the anti-CD22 construct. Such molecules are suitably present in combination in amounts that are effective for the purpose intended. The effective amount of such other agents depends on the amount of anti-CD22 construct present in the formulation, the type of disease or disorder or treatment, and other factors discussed above. These are generally used in the same dosages and with administration routes as described herein or about from 1 to 99% of the heretofore employed dosages.

The anti-CD22 antibodies may also be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are disclosed in Remington's Pharmaceutical Sciences 16th edition, Osol, A. Ed. (1980). Sustained-release preparations may be prepared.

Sustained-release preparations of the anti-CD22 constructs can be prepared. Suitable examples of sustained-release preparations include semipermeable matrices of solid hydrophobic polymers containing the construct (or fragment thereof), which matrices are in the form of shaped articles, e.g., films, or microcapsules. Examples of sustained-release matrices include polyesters, hydrogels (for example, poly(2-hydroxyethyl-methacrylate), or poly(vinyl-alcohol)), polylactides (U.S. Pat. No. 3,773,919), copolymers of L-glutamic acid and ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(−)-3-hydroxybutyric acid. While polymers such as ethylene-vinyl acetate and lactic acid-glycolic acid enable release of molecules for over 100 days, certain hydro gels release proteins for shorter time periods. When encapsulated constructs remain in the body for a long time, they can denature or aggregate as a result of exposure to moisture at 37° C., resulting in a loss of biological activity and possible changes in immunogenicity. Rational strategies can be devised for stabilization of anti-CD22 constructs depending on the mechanism involved. For example, if the aggregation mechanism is discovered to be intermolecular S—S bond formation through thio-disulfide interchange, stabilization can be achieved by modifying sulfhydryl residues, lyophilizing from acidic solutions, controlling moisture content, using appropriate additives, and developing specific polymer matrix compositions.

In some embodiments, the anti-CD22 construct is formulated in a buffer comprising a citrate, NaCl, acetate, succinate, glycine, polysorbate 80 (Tween 80), or any combination of the foregoing. In some embodiments, the anti-CD22 construct is formulated in a buffer comprising about 100 mM to about 150 mM glycine. In some embodiments, the anti-CD22 construct is formulated in a buffer comprising about 50 mM to about 100 mM NaCl. In some embodiments, the anti-CD22 construct is formulated in a buffer comprising about 10 mM to about 50 mM acetate. In some embodiments, the anti-CD22 construct is formulated in a buffer comprising about 10 mM to about 50 mM succinate. In some embodiments, the anti-CD22 construct is formulated in a buffer comprising about 0.005% to about 0.02% polysorbate 80. In some embodiments, the anti-CD22 construct is formulated in a buffer having a pH between about 5.1 and 5.6. In some embodiments, the anti-CD22 construct is formulated in a buffer comprising 10 mM citrate, 100 mM NaCl, 100 mM glycine, and 0.01% polysorbate 80, wherein the formulation is at pH 5.5.

The formulations to be used for in vivo administration must be sterile. This is readily accomplished by, e.g., filtration through sterile filtration membranes.

XI. Dosage and Administration

The dose of the anti-CD22 construct compositions administered to an individual (such as a human) may vary with the particular composition, the mode of administration, and the type of disease being treated. In some embodiments, the amount of the anti-CD22 construct composition is sufficient to result in a complete response in the individual. In some embodiments, the amount of the anti-CD22 construct composition is sufficient to result in a partial response in the individual. In some embodiments, the amount of the anti-CD22 construct composition administered (for example when administered alone) is sufficient to produce an overall response rate of more than about any of 2%, 4%, 6%, 8%, 10%, 15%, 20%, 25%, 30%, 35%, 40%, 45%, 50%, 55%, 60%, 64%, 65%, 70%, 75%, 80%, 85%, or 90% among a population of individuals treated with the anti-CD22 construct composition. Responses of an individual to the treatment of the methods described herein can be determined, for example, based on the percentage tumor growth inhibition (% TGI).

In some embodiments, the amount of the composition is sufficient to prolong overall survival of the individual. In some embodiments, the amount of the composition (for example when administered along) is sufficient to produce clinical benefit of more than about any of 2%, 4%, 6%, 8%, 10%, 15%, 20%, 25%, 30%, 35%, 40%, 45%, 50%, 60%, 70%, or 77% among a population of individuals treated with the anti-CD22 construct composition.

In some embodiments, the amount of the composition is an amount sufficient to decrease the size of a tumor, decrease the number of cancer cells (e.g., $CD22^+$ cells), or decrease the growth rate of a tumor by at least about any of 2%, 4%, 6%, 8%, 10%, 20%, 30%, 40%, 50%, 60%, 70%, 80%, 90%, 95% or 100% compared to the corresponding tumor size, number of cancer cells, or tumor growth rate in the same subject prior to treatment or compared to the corresponding activity in other subjects not receiving the treatment. Standard methods can be used to measure the magnitude of this effect, such as in vitro assays with purified enzyme, cell-based assays, animal models, or human testing.

In some embodiments, the amount of the anti-CD22 construct in the composition is below the level that induces a toxicological effect (i.e., an effect above a clinically acceptable level of toxicity) or is at a level where a potential side effect can be controlled or tolerated when the composition is administered to the individual. In some embodiments, the amount of the composition is close to a maximum tolerated dose (MTD) of the composition following the same dosing regimen. In some embodiments, the amount of the composition is more than about any of 80%, 90%, 95%, or 98% of the MTD. In some embodiments, the amount of an anti-CD22 construct in the composition is included in a range of about 0.001 µg to about 1000 µg. In some embodiments of any of the above aspects, the effective amount of an anti-CD22 construct in the composition is in the range of about 0.1 µg/kg to about 100 mg/kg of total body weight.

The anti-CD22 construct compositions can be administered to an individual (such as human) via various routes, including, for example, intravenous, intra-arterial, intraperitoneal, intrapulmonary, oral, nasal, inhalation, intravesicular, intramuscular, intra-tracheal, subcutaneous, intraocular, intrathecal, intracranial, intracerebral, intracerebroventricular, transmucosal, and transdermal. In some embodiments, sustained continuous release formulation of the composition may be used. In some embodiments, the composition is administered intravenously. In some embodiments, the composition is administered intraarterially. In some embodiments, the composition is administered intraperitoneally. In some embodiments, the composition is administered intrathecally. In some embodiments, the composition is administered intracranially. In some embodiments, the composition is administered intracerebrally. In some embodiments, the composition is administered intracerebroventricularly. In some embodiments, the composition is administered nasally.

EXAMPLES

Example 1

Generation and Selection of Human Anti-CD22 Constructs

This example demonstrates the production of human constructs specific for human CD22. In particular, this example demonstrates the production of human single chain variable fragments (scFvs) that specifically bind human CD22 in native format. Human constructs described herein were developed using naïve or semi-synthetic human phage libraries developed from normal donors and/or diseases donors and selected based on high specificity for CD22 via panning on cell surface expressed human CD22 in its native conformation. Thus, such human constructs may serve as a valuable source for construction of, among other things, full-length IgG, multispecific antibodies, and chimeric antigen receptors that may otherwise be deleted from repertoires found in nature.

Briefly, an exemplary outline for the development of anti-human CD22 constructs is set forth in Table 2. The process started with identification of human CD22-specific and biologically active constructs from the E-ALPHA® phage library. A collection of human scFv antibody phage display libraries (diversity=10×10$^{10}$) constructed at Eureka Therapeutics, named as E-ALPHA® phage libraries, was used for the selection of human constructs specific to human CD22. E-ALPHA® phage libraries included naive libraries consisting of fully naïve human heavy and light chain repertoires, and semi-synthetic libraries containing fully naïve human light chain repertoires and semi-synthetic heavy chain with completely randomized heavy chain CDR3 regions. The naïve antibody repertoires were cloned from PBMCs and spleens of healthy donors or from PBMCs of disease donors. The scFv libraries were used in panning against human CD22 positive cells including Raji (a lymphoma cell line naturally expressing CD22), Jurkat cells expressing full-length CD22, and Jurkat cells expressing domains 5-7 of CD22. The expression of full-length CD22 in Jurkat cells was confirmed by anti-CD22 staining using APC mouse anti-human CD22 antibody (Biolegend, Cat. No. 363505), which only binds to full-length CD22 as in FIGS. 1A-1E. Domains 5-7 of CD22 was conjugated to green fluorescent protein (GFP) and its expression in Jurkat cells was confirmed by FITC signal. Jurkat cells without CD22 expression was used as a negative control. For cell panning, Jurkat cells expressing full-length CD22 or domains 5-7 of CD22, or Raji cells were first mixed with human scFv phage libraries. After extended washing with PBS, cells with bound scFv antibody phage were spun down. The bound clones were then eluted and used to infect E. coli XL1-Blue cells. The phage clones were expressed in bacteria and purified. The panning was performed for three to four rounds to enrich for scFv phage clones that specifically bound the extracellular region of human CD22.

TABLE 2

| Stage | Methodology |
|---|---|
| Primary panning with ALPHA™ phage library | cell panning Flow cytometry screening of phage clones |
| Clone Characterization | Target cancer cell killing Human B cell binding |
| Clone Characterization | Flow Cytometry Target cancer cell killing |

Figure 2B:
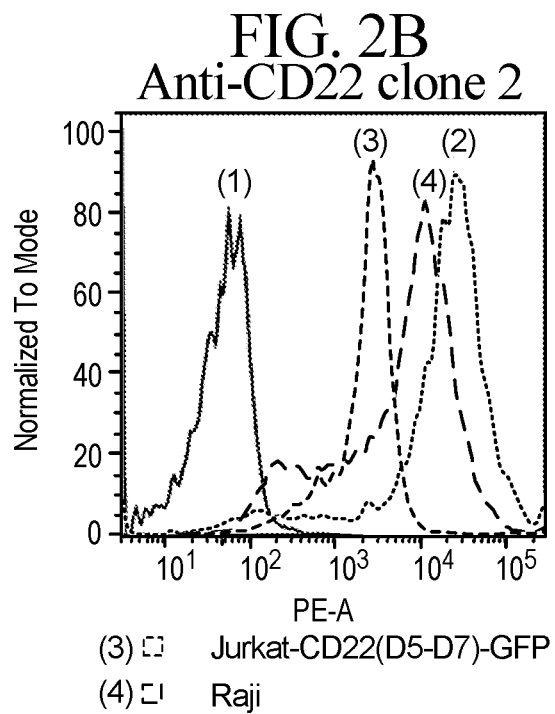
Figure 3A:
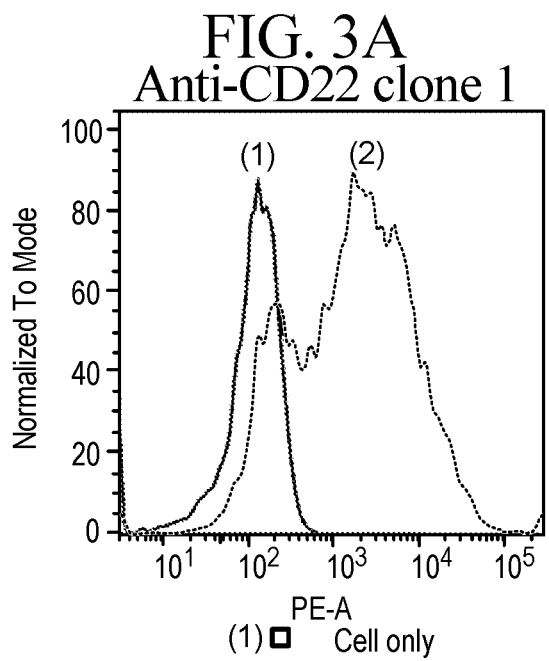
FIGS. 3A and 3B show representative MFI of phage clones 1 and 2 binding of NALM-6 cells, which naturally express CD22, in a flow cytometry assay.
Figure 3B:
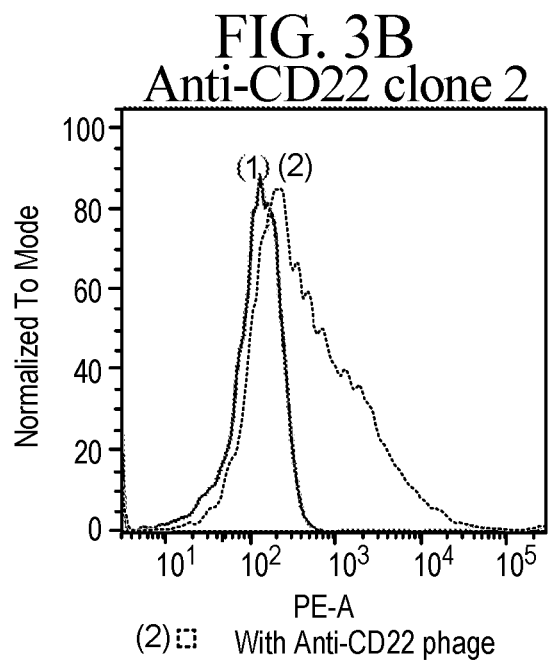

Phage clones selected by cell panning were tested for cell-surface human CD22 binding directly. Out of the 1080 clones screened by phage display, 2 clones were identified as cell-surface CD22 binding clones as confirmed by flow cytometry. As shown in FIGS. 2A and 2B, clones 1 and 2 demonstrated specific binding to CD22$^+$ Raji cells and Jurkat cells expressing full-length CD22 or domains 5-7 of CD22. Moreover, clones 1 and 2 were also demonstrated to bind specifically to NALM-6 cells (a leukemia cell line naturally expressing CD22) as shown in FIGS. 3A and 3B.

Example 2

Characterization of T Cells Expressing Anti-Human CD22 Chimeric Antigen Receptors (CAR-T)

This example describes the construction of chimeric antigen receptors (CARs) using anti-human CD22 antibodies. In particular, this example specifically describes the construction of CARs that include an antigen-binding site of an anti-CD22 antibody and are expressed on the surface of T cells. Further, the CARs expressed by T cells were employed in cytotoxicity assays against human lymphoma cell lines. Thus, the present example illustrates that, in some embodiments, using CARs that include an antigen binding site from human anti-CD22 antibodies described herein is useful for killing target cells that express human CD22 (e.g., lymphoma).

In vitro cytotoxicity of human CD22 transduced T cells. Lenti-viruses containing human CD22 specific chimeric antigen receptors (CARs) were produced by transfection of 293T cells with CAR vectors. In some embodiments, human T cells were used for transduction after one-day stimulation with CD3/CD28 beads (Dynabeads®, Invitrogen) in the presence of IL-2 at 100 U/mL. Concentrated lenti-viruses were applied to T cells in Retronectin (Takara) coated 6-well plates for 72 hours. Functional assessment of transduced T cells (CD22/CAR-T cells) is performed using a LDH Cytotoxicity Assay.

Moreover, in a similar experiment, human CD22 CAR-Ts (described above) were tested using a large panel of CD22 positive and negative cancer cell lines. Briefly, primary T cells were mock-transduced (Mock) or transduced with selected CAR encoding anti-CD22 antibodies. Transduced T cells were analyzed by FACS using an antibody to detect a tag (e.g., a myc tag) in the extracellular domain of the CAR constructs.

Figure 4A:
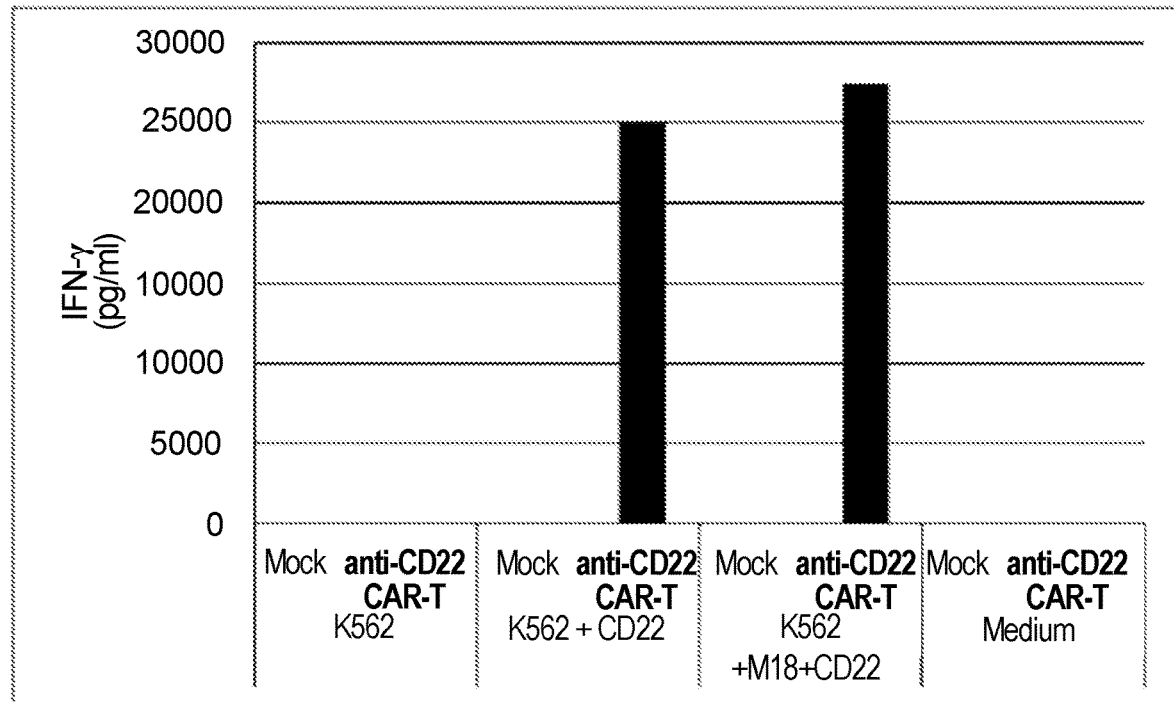
Figure 4B:
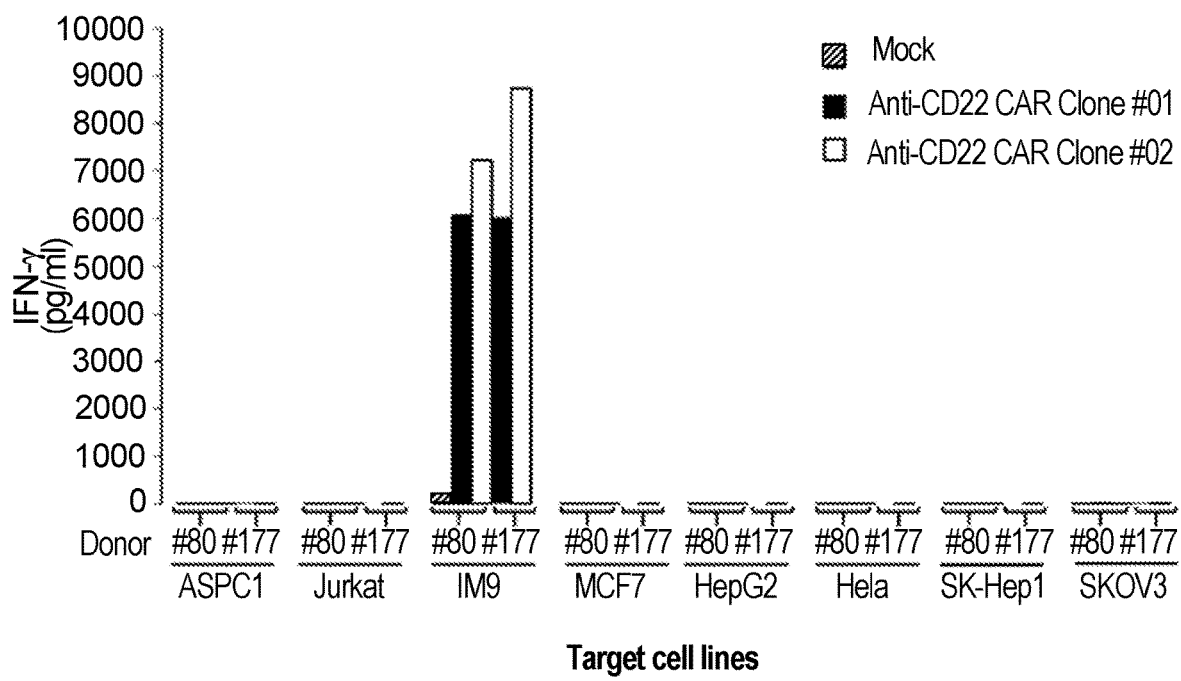
Figure 5A:
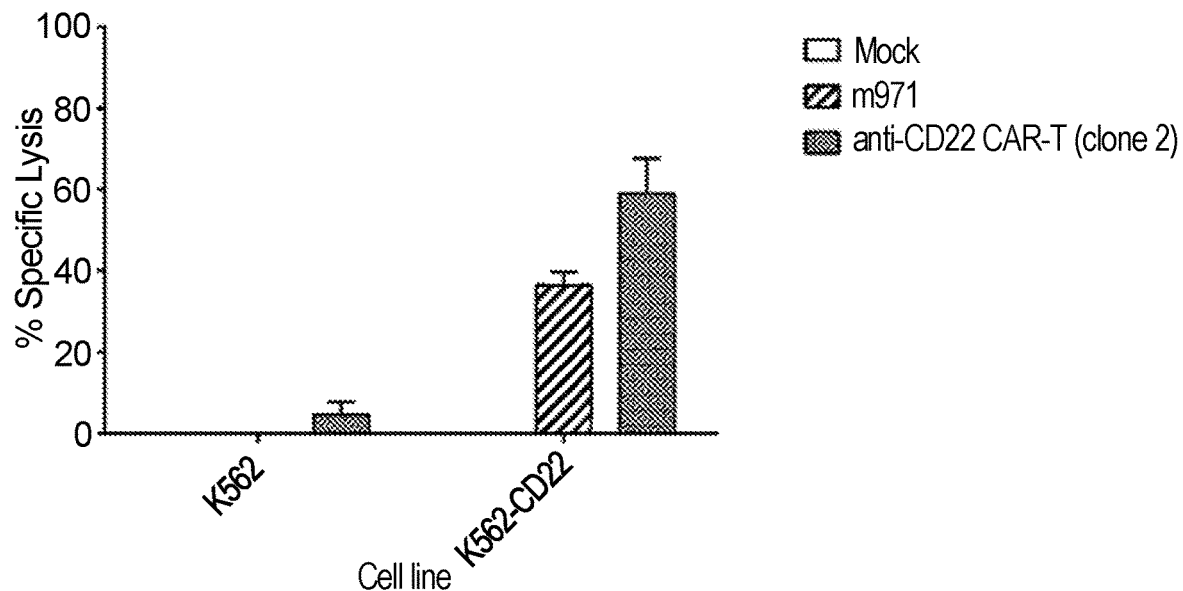
FIGS. 5A and 5B illustrate that anti-CD22 CAR (clone 2) demonstrated specific killing against K562+CD22 target cells and no killing against K562 cells.
Figure 5B:
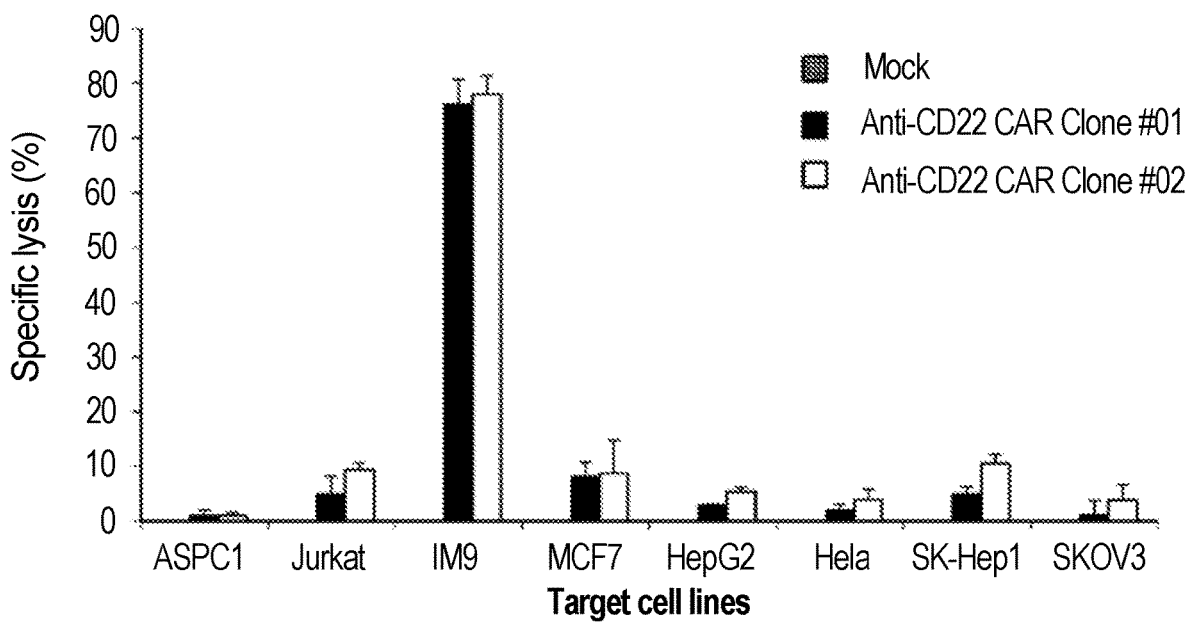

In another experiment, cytokine release profile and target cell lysis of activated human CD22 CAR-T cells was determined. Mock-transduced T cells (mock) or selected anti-CD22 CAR-Ts were co-incubated with target cells (FIG. 4A: K562, K562+CD22, and K562+M18+CD22; FIG. 4B: ASPC1, Jurkat, IM9, MCF7, HepG2, Hela, SK-Hep1, and SKOV3; FIG. 4C: K562, K562+CD22, LnCap, Colo205, and NALM6; FIG. 5A: K562 and K562+CD22; FIG. 5B: ASPC1, Jurkat, IM9, MCF7, HepG2, Hela, SK-Hep1, and SKOV3) in a 2 to 1 ratio for 16 hours. Release of IFN-γ into the media after in vitro killing was measured using the BioPlex 200 system (Bio-Rad) with the Bio-plex Pro Human Cytokine 8-plex Assays (BioRad). Cytokine concentrations were determined using a known standard curve, after subtracting release from media, target cell alone, and clone transduced T cell alone. The results of the IFN-γ release assays are shown in FIGS. 4A, 4B, and 4C, which illustrate that anti-CD22 CAR (clone 2) displayed specific and potent IFN-γ release against CD22$^+$ target cells. FIGS. 5A and 5B further show that anti-CD22 CAR (clone 2) demonstrated specific killing against K562+CD22 target cells and no killing against K562 cells. FIG. 5A also shows that anti-CD22 CAR (clone 2) demonstrated superior killing activity compared to m971 CAR cells (m971 is an antibody that targets the membrane proximal region of CD22).

Example 3

Competition Assay

Figure 6:
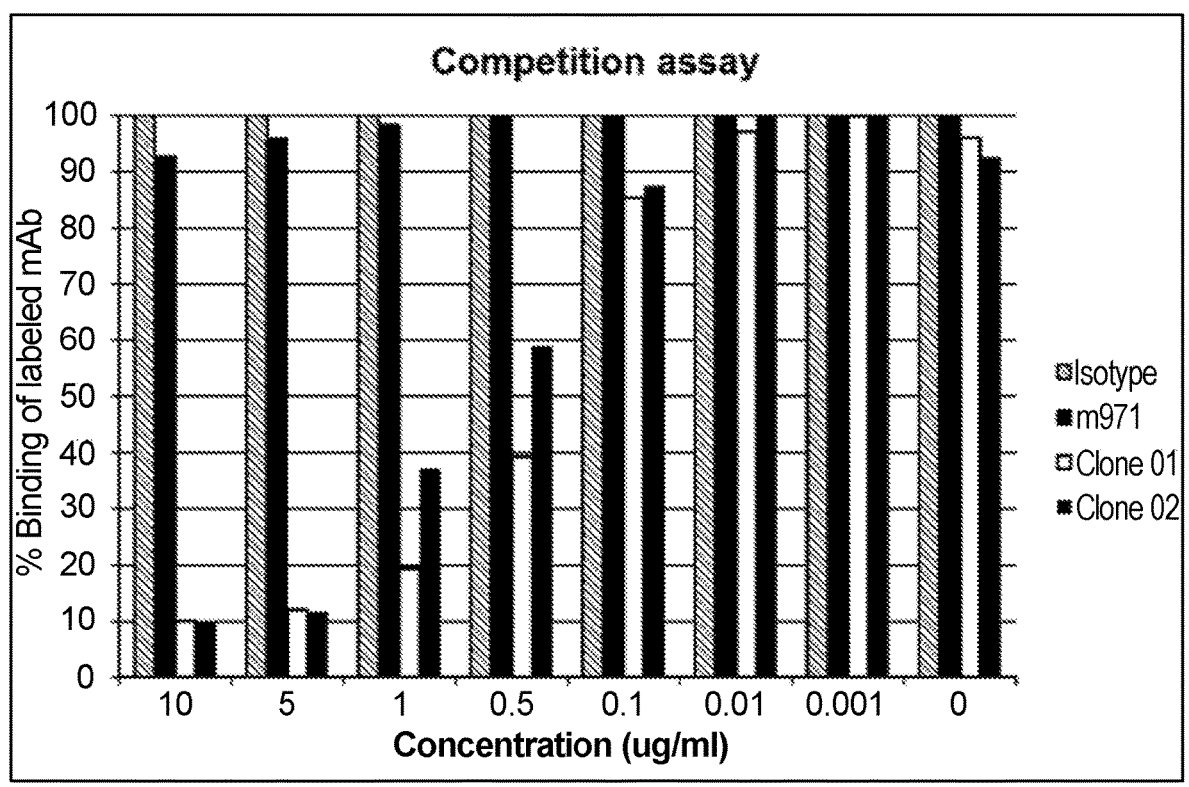
FIG. 6 shows that m971 does not compete with anti-CD22 CAR (clone 2) as measured by flow cytometry.

A flow cytometry competition assay was carried out to determine if m971 competes with anti-CD22 CAR (clone 2). m971 is an antibody that targets the membrane proximal region of CD22. Target cells K562+CD22 were pre-incubated with blocking antibody (m971 or anti-CD22 CAR (clone 1)) at 10 µg/mL, 5 µg/mL, 1 µg/mL, 0.1 µg/mL, 0.01 µg/mL, and 0.001 µg/mL for 30 minutes. After pre-incubation, 1 µg/mL of detecting antibody (anti-CD22 CAR (clone 2) conjugated to biotin) was added directly to the sample without washing and incubated for another 30 minutes. After blocking, FACS was used for detection and analysis. The percent binding was determined from the MFI (mean fluorescence intensity) and samples were normalized against the isotype control. FIG. 6 shows that m971 does not compete with anti-CD22 CAR (clone 2), which binds to a different epitope. FIG. 6 also shows that anti-CD22 CAR (clone 2) and anti-CD22 CAR (clone 1) compete with each other, indicating that they likely bind the same epitope or an overlapping epitope. Anti-CD22 CAR (clone 1) appeared to have higher affinity than anti-CD22 CAR (clone 2) which appeared to have higher affinity than m971.

Example 4

Generation of Bispecific Constructs Using Human Anti-CD22 Antibodies

This example describes the construction of multispecific antibodies using human scFvs specific for human CD22. In particular, this example specifically describes the construction of bispecific antibodies having a first antigen-binding site that binds human CD22 in native format (cell-surface expressed) and a second antigen-binding site. In some embodiments, the second antigen-binding site is a protein expressed on T cells (e.g., CD3 on T cells). Thus, the present example illustrates that, in some embodiments, using multispecific antibodies that contain anti-CD22 antibody moieties as described herein, T cells are directed to kill target cells that express human CD22.

Bispecific antibodies are generated using scFv sequences of the human CD22-specific phage clones (e.g., clones 1 and 2). The bispecific antibodies are constructed using a single-chain format comprising the $V_L$-$V_H$ scFv sequence of a human CD22-specific phage clone at the N-terminal end and an anti-human CD3ε monoclonal scFv at the C-terminal end (e.g., see Brischwein et al., Mol. Immunol. 43:1129, 2006). The DNA fragments encoding the human CD22 scFv and the anti-human CD3εscFv are synthesized and subcloned into a mammalian expression vector, e.g., pQD-T (Eureka Therapeutics, Inc.) using standard recombinant DNA technology. A hexhistamine tag is inserted at the C-terminal end for purification and detection. Mammalian cells, e.g., HEK293 cells, are transfected with the bispecific antibody expression vector and cultured for bispecific antibody production. Bispecific antibodies may subsequently be purified from cell supernatants using, e.g., HisTrap HP column. Cell culture is clarified and loaded onto the column with low imidazole concentration (e.g., 20 mM), and then an isocratic high imidazole concentration elution buffer (e.g., 500 mM) is used to elute bound bispecific antibodies. Molecular weights of purified human CD22 bispecific antibodies are measured under non-reducing conditions by gel electrophoresis.

Example 5

Characterization of Human CD22 Bispecific Antibodies

This example describes the characterization of the binding profile of bispecific antibodies.

Binding to recombinant human CD22 ECD-Fc fusion protein. Phage clones identified as specific binders to cell surface human CD22, e.g., clones 1 and 2, are tested for binding to recombinant human CD22 ECD-Fc fusion protein in solution. In some embodiments, biotinylated human CD22 ECD-Fc fusion proteins are loaded onto a streptavidin biosensor. After washing off excess antigen, bispecific antibodies are tested in PBS buffer for association and dissociation.

Binding to primary human B-cells. Human B-cells are tested for anti-CD22 antibody binding by, for example, co-staining human PBMCs with PerCP-conjugated anti-human CD20 antibody, antibodies targeting the second antigen-binding site (e.g., APC-labeled anti-human CD3 antibodies), and anti-CD22 bispecific antibodies. After a round of brief washing with PBS buffer, FITC-labeled anti-His tag antibody is added to the mixture as the secondary antibody for detection of the bispecific antibody. For the flow cytometry assay, human B-cells are gated by positive CD20 staining and negative CD3 staining. The anti-CD22 bispecific antibodies are evaluated for their ability to recognize human CD22 expressed on these CD20+CD3- cells.

T-cell Killing assay. Tumor cytotoxicity is assayed using, e.g., LDH Cytotoxicity Assay (Promega). Human T cells (AllCells) or Ficoll-purified cells from whole blood (Blood Centers of the Pacific) are activated and expanded with, e.g., CD3/CD28 Dynabeads (Invitrogen). Activated T cells are cultured and maintained in, e.g., RPMI1640 medium with 10% FBS plus 100 U/mL IL-2. Activated T cells are used after a few days, e.g., 7-14 days, post-activation. FACS analysis is used to confirm T cell activation. Activated T cells and target cells are co-cultured at a 5:1 ratio with bispecific antibodies. Cytotoxicity is determined by measuring LDH activity in culture supernatants.

Example 6

Affinity Maturation of Anti-Human CD22 Antibodies

This example describes the affinity maturation of anti-human CD22 antibodies. In particular, generation of a series of antibody variants is performed by incorporation of random mutations into selected anti-human CD22 antibodies (clones 1 and 2) followed by screening and characterization of the antibody variants.

Generation of variant phage libraries. DNA encoding anti-human CD22 scFvs is subjected to random mutagenesis using, e.g., GeneMorph II Random Mutagenesis kit (Agilent Technologies). After mutagenesis, DNA sequences are cloned into an scFv-expressing phagemid vector to build variant antibody phage libraries. Mutation libraries are built for each anti-human CD22 specific clone separately. Individual phage clones from enriched phage panning pools (e.g., variant clones) are tested for enhanced binding to cell-surface human CD22 compared to their respective parental clones. Further, a competition cell-binding assay is performed to compare the binding affinities of the variant clones to those of the parental clones.

Example 7

Generation and Characterization of Bispecific Antibodies Based on Anti-Human CD22 Variant Clones This example describes the construction of multispecific antibodies using variant human scFvs specific for human CD22. In particular, this example specifically describes the construction of bispecific antibodies having a first antigen-binding site that binds human CD22 in native format (cell-surface expressed) and a second antigen-binding site. In some embodiments, the second antigen-binding site may bind CD3 on T cells. Thus, the present example illustrates that, in some embodiments, using multispecific antibodies that contain antibody moieties as described herein, T cells are directed to kill target cells that express human CD22.

Generation of variant clone bispecific antibodies. Bispecific antibodies derived from affinity-improved, variant antibody clones are generated as described in Example 2.

Binding affinity determination for variant bispecific antibodies. Relative binding affinity of the variant clones as compared to parental antibodies is determined through antibody titration flow cytometry using, e.g., human CD22+ cancer cells. Bispecific antibody clones, at serially diluted concentrations, are mixed with Raji cells. Antibody $EC_{50}$ and apparent KD are calculated based on flow cytometry binding signals.

T-cell Killing assay. Tumor cytotoxicity is determined using, e.g., LDH Cytotoxicity Assay (Promega). Human T cells are activated and expanded with, e.g., CD3/CD28 Dynabeads (Invitrogen). Activated T cells are cultured and maintained in, e.g., RPMI1640 medium with 10% FBS plus 100 U/mL IL-2. Activated T cells are used a few days, e.g., 7-14 days, post-activation. FACS analysis is used to confirm T cell activation. Activated T cells and target cells are co-cultured at a 5:1 ratio with bispecific antibodies. Cytotoxicity is determined by measuring LDH activity in culture supernatants.

Example 8

Characterization of T Cells Expressing Anti-Human CD22 Chimeric Antigen Receptors (CAR-T)

In another similar experiment, CAR-Ts generated from selected human antibodies described herein and a non-human (e.g., murine) antibody are tested using a panel of CD22 positive and negative cancer cell lines as described above. Briefly, primary T cells are mock-transduced (Mock) or transduced with selected CAR encoding anti-human CD22 scFvs described herein (e.g., clone 1 or clone 2) or CAR encoding anti-human CD22 scFv which has variable region sequences from an anti-human CD22 murine antibody. Transduced T cells are analyzed by FACs as described above.

In vivo efficacy of CD22 CAR-T cells in human lymphoma xenografts. The in vivo antitumor activity of an exemplary CAR-T cell is tested in a CD22+ human lymphoma xenograft model in NOD SCID gamma (NSG) mice. Cell line Raji-luc-GFP is derived from the CD22+ Burkitt lymphoma cell line, Raji, after stable transfection with dual reporter genes encoding both firefly luciferase (luc) and green fluorescent protein, which results in cells that are able to be traced in vivo using bioluminescent imaging. NSG mice are purchased from Jackson Laboratories (Bar Harbor, ME USA 04609). Raji-luc-GFP cells are re-suspended in PBS and implanted intravenously (i.v.) into NSG mice through tail vein at $1\times10^6$ cells/100 μL/mouse. Five days post-implantation, animals are imaged using Xenogen IVIS imaging system for assessment of tumor burden. Mice are randomized into three groups: (i) no treatment, (ii) mock (non-transduced activated human T cells from the same donor of CAR-T cells), and (iii) clone CAR-T. Animals are treated i.v. with Mock or clone CAR-T cells immediately after randomization at a dose of, e.g., $10^7$ T cells per mouse (comprising $6-8\times10^6$ CAR+ T cells per dose for group (iii)), once every two weeks for 3 doses. Animals are closely monitored after dosing. Bioluminescent imaging using Xenogen IVIS system is taken once a week. Animals with the following conditions are euthanized and recorded as "conditional death": (i) Body weight loss more than 25% initial body weight and (ii) limb paralysis that affects mouse movement.

Post tumor implantation, mice from the anti-CD22 CAR clone-transduced T cell treatment group are re-challenged by i.v. implantation with Raji lymphoma cells to determine if the anti-CD22-CAR-transduced T cells would persist and maintain the capacity to respond to antigen (CD22). Naïve NSG mice (i.e., mice not implanted with Raji lymphoma cells or previously treated with T cells) are implanted with Raji lymphoma cells one-day post injection of mock-transduced T cells as a control. Such mock-transduced T cells may mimic a condition of low level circulating T cells in the mice prior to implantation of Raji lymphoma cells. Tumor burden in each group is measured by luciferase activity.

In another similar experiment, in vivo antitumor activity of an exemplary CAR-T cell is tested in a CD22+ human leukemia xenograft model in NSG mice (NALM). NALM-6-luc-GFP cells are derived from the CD22+ acute lymphoblastic leukemia cell line NALM-6 after stable transfection with dual reporter genes encoding both firefly luciferase (luc) and green fluorescent protein (GFP), resulting in cells traceable in vivo using bioluminescent imaging.

Briefly, NALM-6-luc-GFP is cultured in RPMI Medium+ 10% FBS at 37° C. in a humidified atmosphere with 5% $CO_2$. NSG mice are purchased from Jackson Laboratories (Bar Harbor, ME USA 04609) and acclimated prior to experimentation. NALM-6-luc-GFP cells are re-suspended in phosphate-buffered saline (PBS) and intravenously (i.v.) implanted into female NSG mice at, e.g., $5\times10^5$ cells/100 μL/mouse via tail vein injection. Post implantation, animals are imaged using Xenogen IVIS imaging system for tumor burden assessment. NSG mice are randomized into three groups: (i) vehicle (PBS); (ii) mock-transduced human T cells; and (iii) clone anti-CD22 CAR-transduced T cells. Animals are closely monitored after implantation and dosing with T cells or vehicle as described above.

Example 9

Generation and Characterization of T Cells Expressing Monospecific Anti-Human CD22 Chimeric Antibody-T Cell Receptors (caTCR)

This example describes the generation and characterization of T cells expressing various monospecific caTCR constructs that comprise anti-human CD22 Fabs described herein. Some of the caTCR constructs comprise both an anti-CD22 Fab and an anti-CD22 scFv described herein. Some of the caTCR-T cells further express a chimeric signaling receptor (CSR).

Generation of T cells expressing anti-human CD22-caTCR. Briefly, primary T cells were mock-transduced (Mock) or transduced with selected caTCR encoding nucleic acids. In particular, nucleic acids encoding the following caTCR constructs or caTCR+CSR construct combinations were generated and used in the transduction:

Construct combination 1 (SEQ ID NO: 1): anti-CD19-caTCR+anti-CD19-CSR

Construct 2 (SEQ ID NO: 2): anti-CD22-caTCR

Construct combination 3 (SEQ ID NO: 3): anti-CD22-caTCR+anti-CD19-CSR

Construct 4 (SEQ ID NO: 4): anti-CD22-scFv-anti-CD22-caTCR (also referred to as bivalent-monospecific anti-CD22-caTCR)

Construct combination 5 (SEQ ID NO: 5): anti-CD22-scFv-anti-CD22-caTCR+anti-CD19-CSR Construct combination 6 (SEQ ID NO: 6): anti-CD22-scFv-anti-CD22-caTCR+anti-CD22-CSR.

In construct combinations 1, 3, 5, and 6, the CSR comprises a truncated CD28 (SEQ ID NO: 157), which comprises CD28 transmembrane region sequence and intracellular signaling sequences.

In addition, nucleic acids encoding the following construct combinations are generated and transduced into primary T cells:

Construct combination 7 (SEQ ID NO: 7): anti-CD22-scFv-anti-CD22-caTCR+anti-CD22-CSR-with CD8 TM sequence and a 4-1BB IC signaling sequence (SEQ ID NO: 173)

Construct combination 8 (SEQ ID NO: 8): anti-CD22-scFv-anti-CD22-caTCR+anti-CD22-CSR-with truncated 4-1BB (SEQ ID NO: 159)

Construct combination 9 (SEQ ID NO: 9): anti-CD22-scFv-anti-CD22-caTCR+anti-CD22-CSR-with CD8 TM sequence and a CD27 IC signaling sequence (SEQ ID NO: 167)

Construct combination 10 (SEQ ID NO: 10): anti-CD22-scFv-anti-CD22-caTCR+anti-CD22-CSR-with truncated CD27 (SEQ ID NO: 161)

Construct combination 11 (SEQ ID NO: 11): anti-CD22-scFv-anti-CD22-caTCR+anti-CD22-CSR-with CD8 TM sequence and a CD30 IC signaling sequence (SEQ ID NO: 169)

Construct combination 12 (SEQ ID NO: 12): anti-CD22-scFv-anti-CD22-caTCR+anti-CD22-CSR-with truncated CD30 (SEQ ID NO: 163)

Construct combination 13 (SEQ ID NO: 13): anti-CD22-scFv-anti-CD22-caTCR+anti-CD22-CSR-with CD8 TM sequence and a OX40 IC signaling sequence (SEQ ID NO: 171)

Construct combination 14 (SEQ ID NO: 14): anti-CD22-scFv-anti-CD22-caTCR+anti-CD22-CSR-with truncated OX40 (SEQ ID NO: 165).

Further, nucleic acids encoding the construct combinations 5-14 (SEQ ID NOS: 5-14) but with the myc tag (SEQ ID NO: 194) removed are also generated and transduced into primary T cells.

In the constructs and construct combinations disclosed in this Example, each CSR and the co-expressed caTCR are translated as a single polypeptide initially, and then get cleaved into separate polypeptides. In other embodiments, co-expressed CSR and caTCR can be constructed as separately translated polypeptides encoded on the same nucleic acid or even encoded on different nucleic acids.

Characterization of T cells expressing anti-human CD22 caTCR. Primary T cells were transduced with nucleic acids encoding construct combinations 1, 3, 5, and 6 (SEQ ID NOS: 1, 3, 5, and 6, respectively), constructs 2 and 4 (SEQ ID NOS: 2 and 4, respectively), or mock transduced (with no nucleic acids). Transduction efficiency was determined by cell surface staining, with Fab as the marker for caTCR expression and myc tag as the marker for CSR expression. The results indicated that caTCR$^+$ cell percentages and CSR$^+$ cell percentages were about the same in the same T cell samples transduced with caTCR-CSR-encoding nucleic acids. All caTCR-transduced T-cells were matched at (normalized to) approximately 46% caTCR receptor positive by mixing with mock T-cells, and caTCR$^+$ cells were used as the effector cells.

Figure 7:
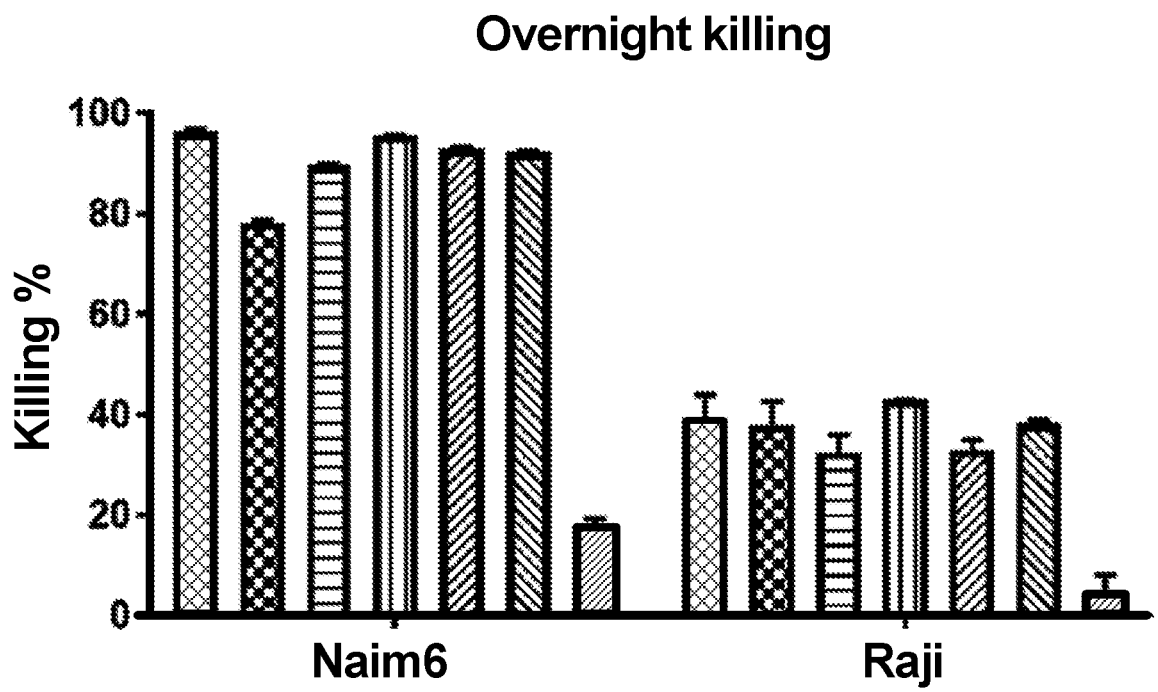
FIG. 7 shows that caTCR T cells expressing any one of the constructs 2 and 4 and construct combinations 1, 3, 5, and 6 had high killing efficacy in both NALM6 cells and Raji cells.

In vitro killing. CD80/86 negative NALM6-luc-GFP cells and CD80/CD86 positive Raji-luc-GFP cells (leukemia and lymphoma cells expressing CD22 and CD19) were used as target cells in separate experiments for T-cell stimulation at an effector-to-target ratio of 1:1 and incubated with the caTCR T cells for overnight (about 16 h). Specific T-cell lysis was measured after the overnight incubation using the Cytox 96 Non-radioactive Cytotoxicity Assay (Promega). Live target cells were counted, and killing percentage was calculated as the difference between the percentage of the remaining live target cells in each group compared to that of the group with target alone (no T cells). The result are shown in FIG. 7. The caTCR T cells expressing any one of the six constructs and construct combinations (SEQ ID NOS: 1-6) had very high killing efficacy in NALM6 cells. They also had significant killing efficacy in Raji cells, although not as high as in NALM6 at the tested effector-to-target ratio of 1:1.

Similar in vitro killing experiments are carried out using the NALM6-luc-GFP cells and Raji-luc-GFP cells as the target cells and primary T cells transduced with nucleic acids encoding construct combinations 7-14 as the effector cells.

Figure 8:
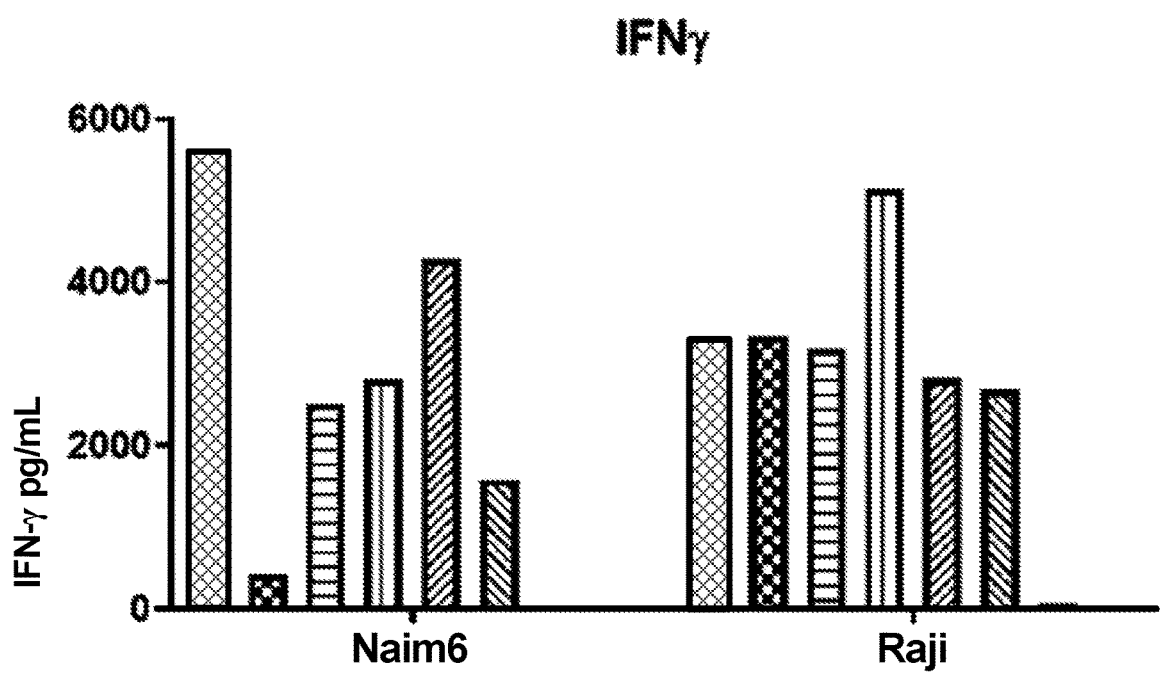
FIG. 8 shows that caTCR T cells expressing any one of the constructs 2 and 4 and construct combinations 1, 3, 5, and 6 had high IFN-γ release levels from NALM6 and Raji cells.

Cytokine secretion. In addition to measuring live target cell numbers, the concentration of IFN-γ released into the supernatant of the in vitro killing reactions was measured as another indicator of cell killing with a Human IFN-γ ELISA MAX™ kit from Biolegend. The results are shown in FIG. 8. The caTCR T cells expressing any one of the six constructs and construct combinations had high IFN-γ release levels from Raji cells, especially construct 4 (anti-CD22-scFv-anti-CD22-caTCR (also referred to as bivalent-monospecific anti-CD22-caTCR)). Most of the anti-CD22-caTCR T cell groups also had high IFN-γ release levels from NALM6 cells.

Similarly, the concentration of IFN-γ released into the supernatant of the in vitro killing reactions from NALM6 cells and Raji cells with T cells expressing construct combinations 7-14 is measured with the same method.

Figure 9B:
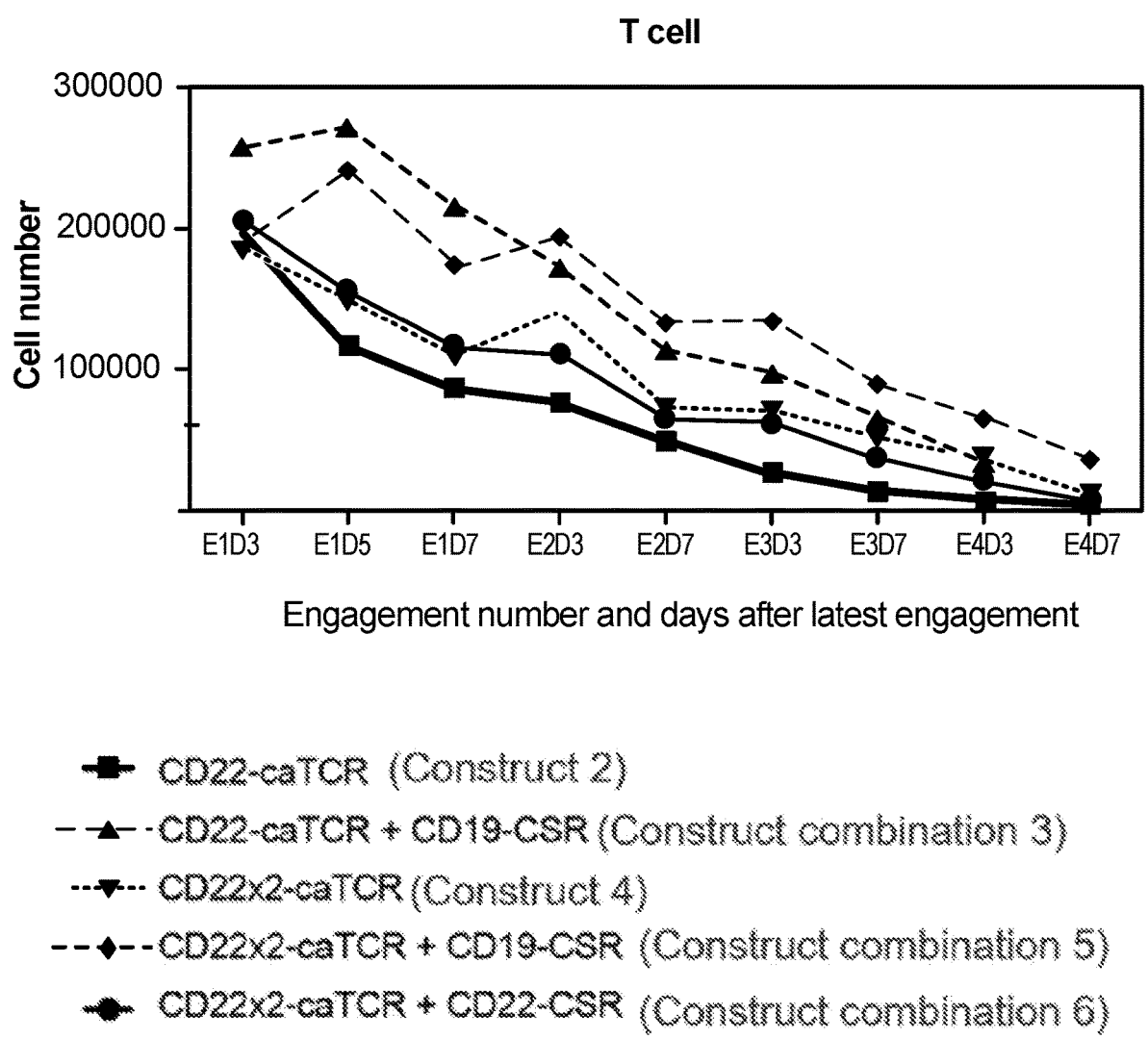
Figure 10A:
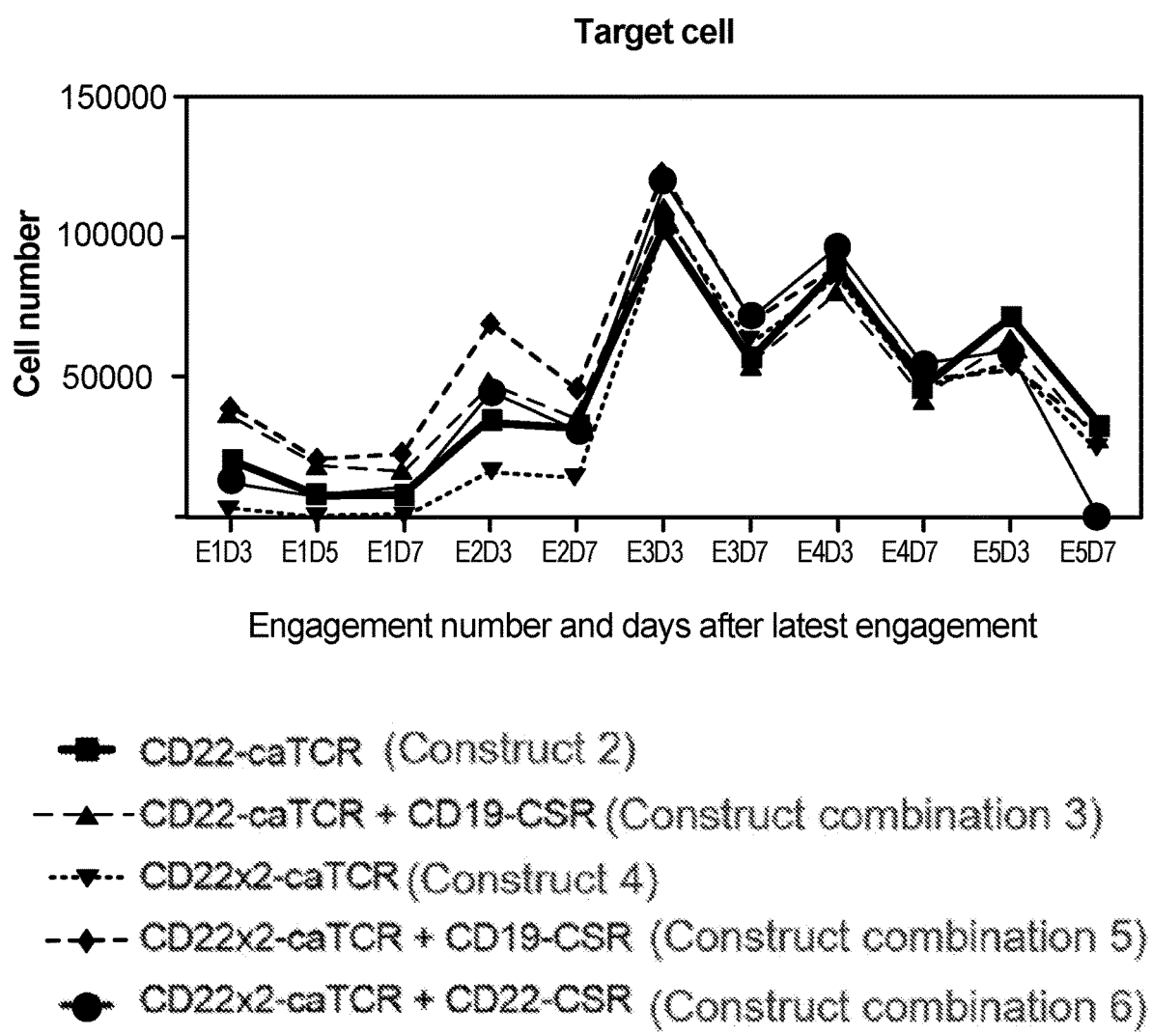
Figure 11:
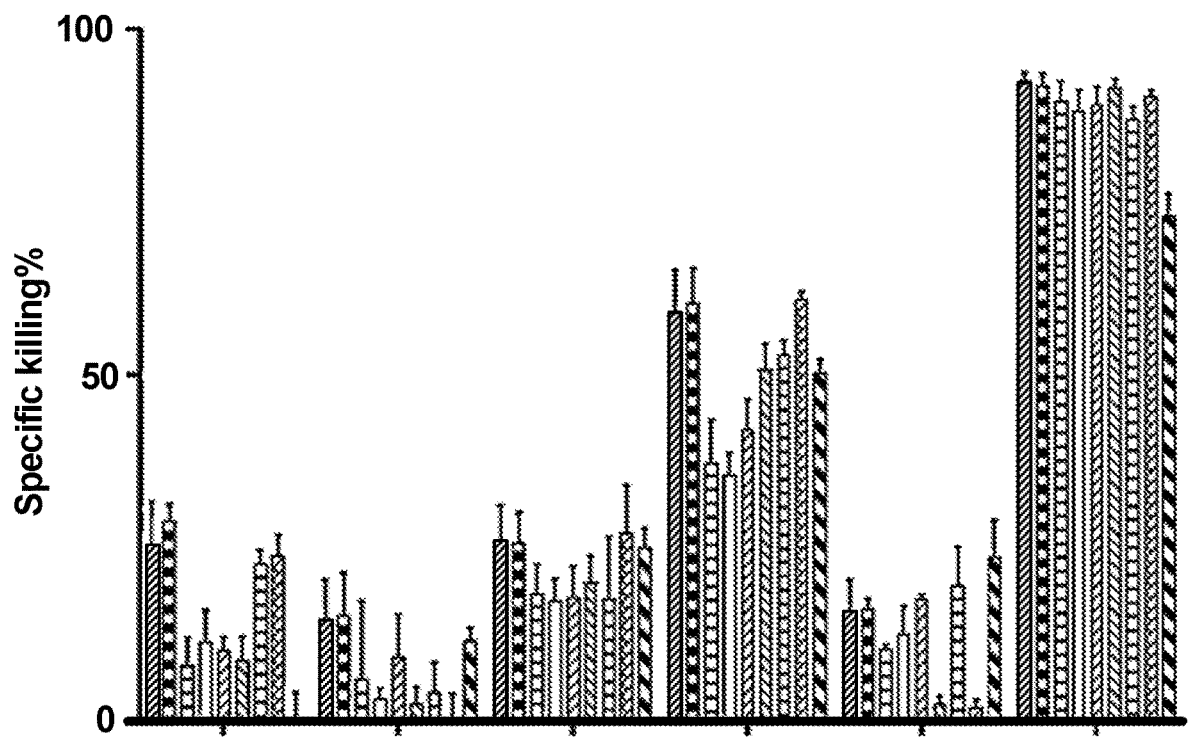
FIG. 11 shows that caTCR T cells expressing any one of the constructs 2, 15-21, and 22 had high killing efficacy in NALM6 cells, Raji cells, and K562 cells.
Figure 12A:
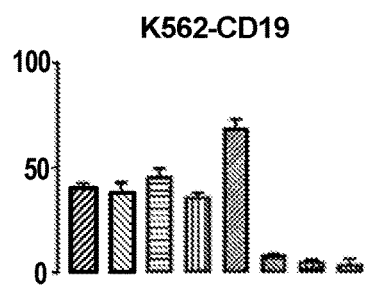
FIGS. 12A-12F show that caTCR T cells expressing any one of the constructs 2, 22, 24-27, and 28 had high killing efficacy in NALM6 cells, Raji cells, and K562 cells.
Figure 12B:
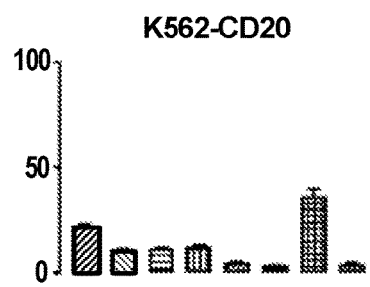
Figure 12C:
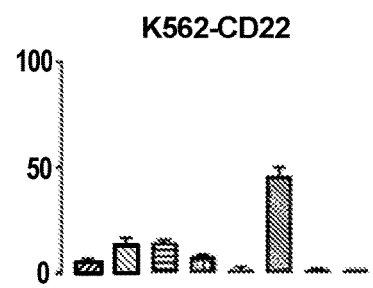
Figure 12D:
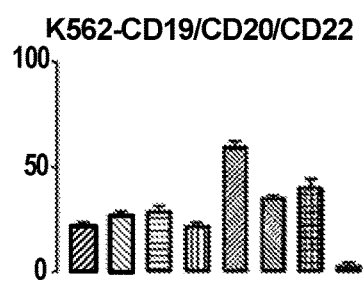
Figure 12E:
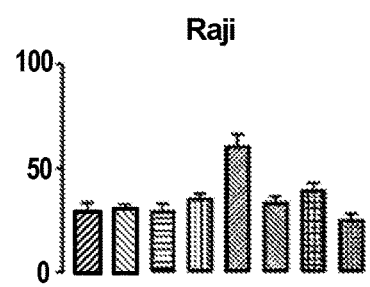
Figure 12F:
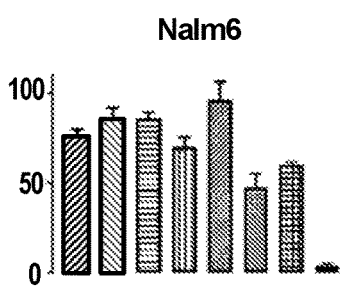

Target cell re-challenge. T cells expressing any one of construct combinations 3, 5, and 6 (SEQ ID NOS: 1, 3, 5, and 6, respectively) and constructs 2 and 4 (SEQ ID NOS:

2 and 4, respectively) were initially co-cultured with 50,000 NALM6-luc-GFP or Raji-luc-GFP target cells at an effector-to-target ratio of 1:1. Every 7 days 100,000 of new target cells were added to the same co-culture to re-challenge (or "engage") the T cells. Remaining target cells and T cells in the co-culture were counted twice a week using flow analysis to evaluate the killing activity of T cells. The results with NALM6 as the target cells are shown in FIG. 9A (target cell numbers) and FIG. 9B (total T cell number), while the results with Raji as the target cells are shown in FIG. 10A (target cell numbers) and FIG. 10B (total T cell number). Anti-CD22-caTCR T cells expressing any one of the five constructs and construct combinations (SEQ ID NOS: 2-6) maintained high killing efficacy in NALM6 cells up to at least three weeks and after three or more rounds of target engagements (e.g., at E3D7 and E4D3). For NALM6 target cells, T cells expressing construct combination 5 (anti-CD22-scFv-anti-CD22-caTCR+anti-CD19-CSR) persisted for the longest time among the five constructs and construct combinations. Anti-CD22-caTCR T cells expressing any one of the five constructs and construct combinations also had significant killing efficacy in Raji cells up to about five weeks and after a total of five rounds of target engagements.

Similar target cell re-challenge experiments are carried out using the NALM6-luc-GFP cells and Raji-luc-GFP cells as the target cells and primary T cells transduced with nucleic acids encoding each of construct combinations 1 and 7-14 as the effector cells.

The results of the experiments described in this Example show that T cells transduced to express anti-CD22-caTCR successfully killed target cancer cells expressing CD22. Such cells also persisted for at least weeks and maintained their target cell killing capability.

Example 10

Generation and Characterization of T Cells Expressing Bispecific or Trispecific Anti-Human CD22-caTCR This example describes the generation and characterization of T cells expressing various bispecific or trispecific caTCR constructs that comprise anti-human CD22 Fabs and one or two additional antibody variable region fragments targeting non-CD22 antigens as described herein. Some of the caTCR-T cells further express a CSR.

Generation of T cells expressing various caTCR including bispecific or trispecific anti-human CD22-caTCR. Briefly, primary T cells were mock-transduced (Mock) or transduced with selected caTCR encoding nucleic acids. In particular, nucleic acids encoding the following constructs 15-21 (SEQ ID NOS: 15-21, respectively) were generated and used in the transduction.

In vitro killing. Following a similar protocol as described in Example 9, CD80/86 negative NALM6-luc-GFP cells, CD80/CD86 positive Raji-luc-GFP cells (leukemia and lymphoma cells expressing CD22 and CD19), and K562 cells were used as target cells in separate experiments for T-cell stimulation at an effector-to-target ratio of 1:1 and incubated with the caTCR T cells for overnight (about 16 h). Specific T-cell lysis was measured after the overnight incubation using the Cytox 96 Non-radioactive Cytotoxicity Assay (Promega). Live target cells were counted, and killing percentage was calculated as the difference between the percentage of the remaining live target cells in each group compared to that of the group with target alone (no T cells). The result are shown in FIG. 11 and FIGS. 12A-12F. The caTCR T cells expressing any one of the bispecific constructs (constructs 15-21 (SEQ ID NOS: 15-21, respectively)) or monospecific constructs (constructs 2, 22, and 28 (SEQ ID NOS: 2, 22, and 28, respectively)) had very high killing efficacy in the cells.

Similar in vitro killing experiments are carried out following the same experimental protocol using nucleic acids encoding construct combination 23 (SEQ ID NO: 23), constructs 24-27 (SEQ ID NOS: 24-27, respectively), and construct combinations 29-75 (SEQ ID NOS: 29-75, respectively).

Figure 13A:
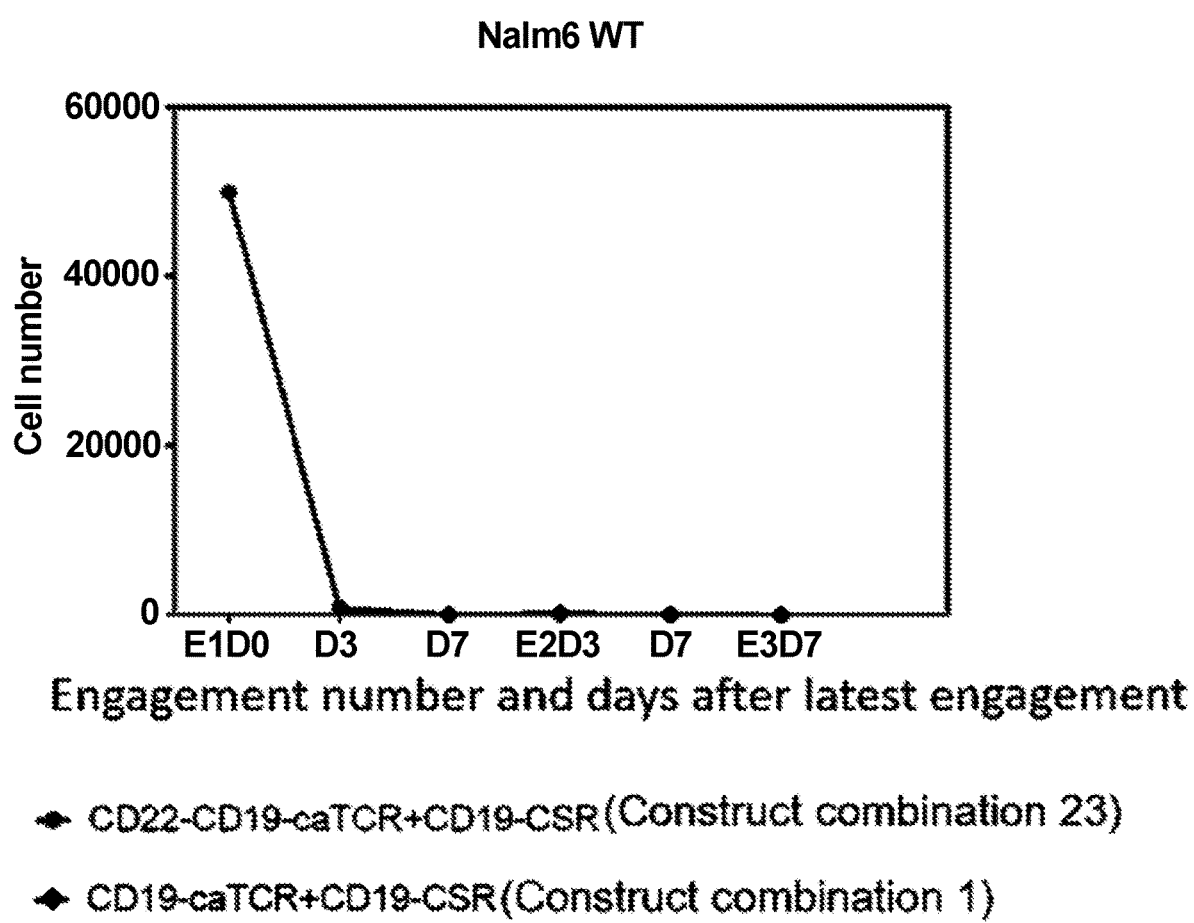
FIGS. 13A and 13B show that anti-CD22-caTCR T cells expressing any one of the construct combinations 1 and 23 maintained high killing efficacy in NALM6 cells.
Figure 13B:
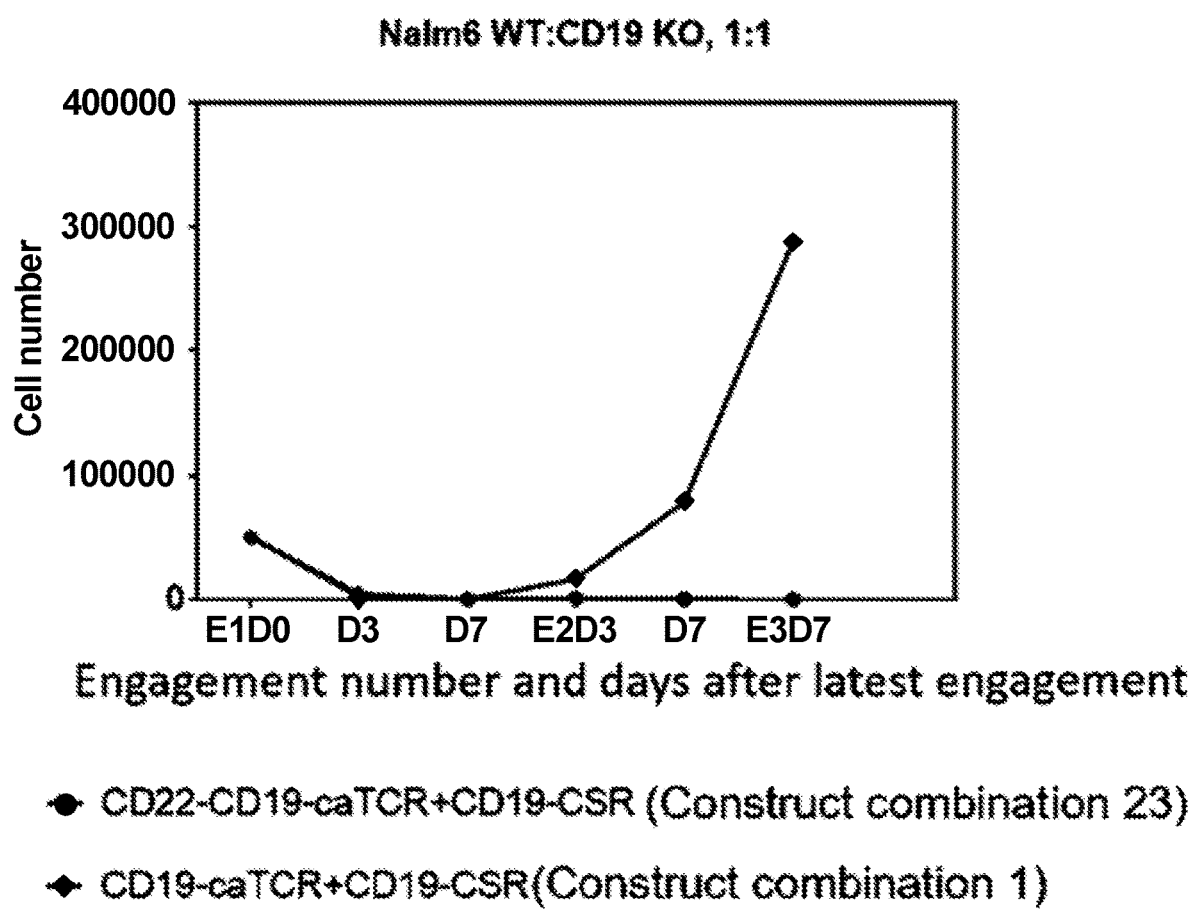

Target cell re-challenge. Following a similar protocol as described in Example 9, T cells expressing construct combinations 1 and 23 were initially co-cultured with 50,000 NALM6-luc-GFP target cells at an effector-to-target ratio of 1:1. Every 7 days 100,000 of new target cells were added to the same co-culture to re-challenge (or "engage") the T cells. Remaining target cells and T cells in the co-culture were counted twice a week using flow analysis to evaluate the killing activity of T cells. The results with NALM6 as the target cells are shown in FIG. 13A and FIG. 13B.

Similar target cell re-challenge experiments are carried out following the same experimental protocol using nucleic acids encoding each of constructs and construct combinations 15-21, 24-27, and 29-75 (SEQ ID NOS: 15-21, 24-27, and 29-75, respectively).

Example 11

Generation and Characterization of T Cells Expressing Other Construct Combinations This example describes the generation and characterization of T cells expressing various other caTCR-CSR construct combinations that comprise anti-human CD22 Fabs and one or two additional antibody variable region fragments targeting non-CD22 antigens as described herein. Some of the caTCR-T cells further express a CSR.

Following a similar protocol as described above, primary T cells are mock-transduced (Mock) or transduced with nucleic acids encoding the following construct combinations:

(1) a construct combination that comprises a caTCR and a CSR, in which the caTCR has a sequence that has at least 90% (e.g., 92%, 94%, 96%, 98%, 99%, or 100%) identity to the sequence of SEQ ID NO: 77 and the CSR has a sequence that has at least 90% (e.g., 92%, 94%, 96%, 98%, 99%, or 100%) identity to the sequence of any one of SEQ ID NOS: 81-96;

(2) a construct combination that comprises a caTCR and a CSR, in which the caTCR has a sequence that has at least 90% (e.g., 92%, 94%, 96%, 98%, 99%, or 100%) identity to the sequence of SEQ ID NO: 77 and the CSR has a sequence that has at least 90% (e.g., 92%, 94%, 96%, 98%, 99%, or 100%) identity to the sequence of any one of SEQ ID NOS: 97-112;

(3) a construct combination that comprises a caTCR and a CSR, in which the caTCR has a sequence that has at least 90% (e.g., 92%, 94%, 96%, 98%, 99%, or 100%) identity to the sequence of SEQ ID NO: 77 and the CSR has a sequence that has at least 90% (e.g., 92%, 94%, 96%, 98%, 99%, or 100%) identity to the sequence of any one of SEQ ID NOS: 113-128;

(4) a construct combination that comprises a caTCR and a CSR, in which the caTCR has a sequence that has at least 90% (e.g., 92%, 94%, 96%, 98%, 99%, or 100%) identity to the sequence of SEQ ID NO: 78 and the CSR has a sequence that has at least 90% (e.g., 92%, 94%, 96%, 98%, 99%, or 100%) identity to the sequence of any one of SEQ ID NOS: 81-96;

(5) a construct combination that comprises a caTCR and a CSR, in which the caTCR has a sequence that has at least 90% (e.g., 92%, 94%, 96%, 98%, 99%, or 100%) identity to the sequence of SEQ ID NO: 78 and the CSR has a sequence that has at least 90% (e.g., 92%, 94%, 96%, 98%, 99%, or 100%) identity to the sequence of any one of SEQ ID NOS: 97-112; and (6) a construct combination that comprises a caTCR and a CSR, in which the caTCR has a sequence that has at least 90% (e.g., 92%, 94%, 96%, 98%, 99%, or 100%) identity to the sequence of SEQ ID NO: 78 and the CSR has a sequence that has at least 90% (e.g., 92%, 94%, 96%, 98%, 99%, or 100%) identity to the sequence of any one of SEQ ID NOS: 113-128.

In some embodiments, an anti-CD22 construct combination comprises a caTCR that has a light chain variable region having a sequence that has at least 90% identity (e.g., at least 92%, 94%, 96%, 98%, or 99% identity) to the sequence of SEQ ID NO: 212 and a heavy chain variable region having a sequence that has at least 90% identity (e.g., at least 92%, 94%, 96%, 98%, or 99% identity) to the sequence of SEQ ID NO: 213.

In some embodiments, an anti-CD22 construct combination comprises a caTCR that has a light chain variable region having a sequence that has at least 90% identity (e.g., at least 92%, 94%, 96%, 98%, or 99% identity) to the sequence of SEQ ID NO: 218 and a heavy chain variable region having a sequence that has at least 90% identity (e.g., at least 92%, 94%, 96%, 98%, or 99% identity) to the sequence of SEQ ID NO: 219.

In some embodiments, an anti-CD22 construct combination comprises a CSR that has a light chain variable region having a sequence that has at least 90% identity (e.g., at least 92%, 94%, 96%, 98%, or 99% identity) to the sequence of SEQ ID NO: 212 and a heavy chain variable region having a sequence that has at least 90% identity (e.g., at least 92%, 94%, 96%, 98%, or 99% identity) to the sequence of SEQ ID NO: 213.

In some embodiments, an anti-CD22 construct combination comprises a CSR that has a light chain variable region having a sequence that has at least 90% identity (e.g., at least 92%, 94%, 96%, 98%, or 99% identity) to the sequence of SEQ ID NO: 218 and a heavy chain variable region having a sequence that has at least 90% identity (e.g., at least 92%, 94%, 96%, 98%, or 99% identity) to the sequence of SEQ ID NO: 219.

Nucleic acids encoding any of the anti-CD22 construct combinations described in any of the above embodiments are also transduced into primary T cells.

Following a similar protocol as described above, any of the anti-CD22 construct combinations described in any of the above embodiments are also tested in in vitro killing and target cell re-challenge experiments.

Example 12

In Vivo Efficacy Study of T Cells Transduced with Anti-CD22 Constructs or Construct Combinations The in vivo anti-tumor activity of T cells expressing one or more of anti-CD22 constructs and construct combinations described herein is tested in a human CD19+ NALM-6 pre-B Acute Lymphoblastic Leukemia (ALL) model. Luciferase-expressing NALM-6 cells are implanted intravenously (i.v.) into NOD SCID gamma (NSG) immune-compromised mice and tumor burden is assessed by measuring tumor-derived bioluminescence. Six days post tumor implantation, mice are randomized based on total bioluminescent flux into treatment groups: (1) i.v. injection of $5 \times 10^6$ un-transduced donor-matched (Mock) T cells, (2) i.v. injection of $2 \times 10^6$ T cells expressing an anti-CD22 caTCR construct only ("caTCR T cell") and (3) i.v. injection of $2 \times 10^6$ T cells expressing both anti-CD19 caTCR and anti-CD19 CSR ("caTCR CSR T cell"; n=6 mice/group). Health effects resulting from T cell infusions in mice are assessed by monitoring their general appearance, body weight, and other clinical signs of adverse response (including hypothermia, labored respiration, and hind-limb paralysis/weakness).

To determine the level of cytokine release in vivo, key cytokines, including those related to clinical cytokine release syndrome, are analyzed 24 hours after the NALM-6 tumor-bearing mice are administered with anti-CD22 CAR-T cells or caTCR CSR T cells. Cytokine levels are quantified with Luminex Magpix technology using BioRad Bio-Plex kits.

EXEMPLARY EMBODIMENTS

Exemplary embodiments provided in accordance with the presently disclosed subject matter include, but are not limited to, the embodiments and the following embodiments:

1. An anti-CD22 construct comprising an antibody moiety that specifically binds to CD22, wherein the antibody moiety comprises:
   (a) a light chain variable region (VL) comprising a light chain complementarity determining region (LC-CDR) 1, an LC-CDR2, and an LC-CDR3 of the light chain variable region of SEQ ID NO: 218 or 212; and
   (b) a heavy chain variable region (VH) comprising a heavy chain complementarity determining region (HC-CDR) 1, an HC-CDR2, and an HC-CDR3 of the heavy chain variable region of SEQ ID NO: 219 or 213.

2. The anti-CD22 construct of embodiment 1, wherein the antibody moiety comprises the LC-CDR1, the LC-CDR2, and the LC-CDR3 of the light chain variable region of SEQ ID NO: 218.

3. The anti-CD22 construct of embodiment 1, wherein the antibody moiety comprises the LC-CDR1, the LC-CDR2, and the LC-CDR3 of the light chain variable region of SEQ ID NO: 212.

4. The anti-CD22 construct of embodiment 1 or 2, wherein the antibody moiety comprises:
   (a) the light chain variable region (VL) comprising the LC-CDR1, the LC-CDR2, and the LC-CDR3 of the light chain variable region of SEQ ID NO: 218; and
   (b) a heavy chain variable region (VH) comprising the HC-CDR1, the HC-CDR2, and the HC-CDR3 of the heavy chain variable region of SEQ ID NO: 219.

5. The anti-CD22 construct of embodiment 1 or 3, wherein the antibody moiety comprises:
   (a) the light chain variable region (VL) comprising the LC-CDR1, the LC-CDR2, and the LC-CDR3 of the light chain variable region of SEQ ID NO: 212; and
   (b) a heavy chain variable region (VH) comprising the HC-CDR1, the HC-CDR2, and the HC-CDR3 of the heavy chain variable region of SEQ ID NO: 213.

6. The anti-CD22 construct of embodiment 1, wherein the antibody moiety comprises one or more of:
   the LC-CDR1 having a sequence of HDIRNY (SEQ ID NO: 214), the LC-CDR2 having a sequence of AAS (SEQ ID NO: 215),
the LC-CDR3 having a sequence of QQYDGLPLT (SEQ ID NO: 216),
the HC-CDR1 having a sequence of GFTFSNYA (SEQ ID NO: 209),
the HC-CDR2 having a sequence of ISGSGGST (SEQ ID NO: 210), and
the HC-CDR3 having a sequence of ARYGSAAWMDS (SEQ ID NO: 217).

7. The anti-CD22 construct of embodiment 6, wherein the antibody moiety comprises the sequences of SEQ ID NOS: 209, 210, and 214-217.

8. The anti-CD22 construct of embodiment 6 or 7, wherein the light chain variable region has a sequence having at least 90% identity to the sequence of DIQLTQSPSSLSTSVGDRVTITCQASHDIR-NYLNWYQQKPGKAPNLLIYAASNLQTGV PSRFSGRGSGTDFTLTISSLQPEDI-ATYYCQQYDGLPLTFGQGTRLEIKR (SEQ ID NO: 218).

9. The anti-CD22 construct of any one of embodiments 6 to 8, wherein the heavy chain variable region has a sequence having at least 90% identity to the sequence of QVQLVESGGGLVQPGGSLRLS-CAASGFTFSNYAMSWVRQAPGKGLEWVS SIS-GSGG STYYADSVKGRFTISRDTSKNT-LYLQMNSLRAEDTAVYYCARYGSAAWMD SWGQG TLVTVSS (SEQ ID NO: 219).

10. An anti-CD22 construct comprising a light chain variable region and a heavy chain variable region, wherein
the light chain variable region has a sequence having at least 90% identity to the sequence of DIQLTQSPSSLSTSVGDRVTITCQASHDIR-NYLNWYQQKPGKAPNLLIYAASNLQTGV PSRFSGRGSGTDFTLTISSLQPEDI-ATYYCQQYDGLPLTFGQGTRLEIKR (SEQ ID NO: 218), and
the heavy chain variable region has a sequence having at least 90% identity to the sequence of QVQLVES-GGGLVQPGGSLRLSCAASGFTFSNYAM-SWVRQAPGKGLEWVSSISGSGG STYY-ADSVKGRFTISRDTSKNTLYLQMNSLRAED TAVYYCARYGSAAWMDSWGQG TLVTVSS (SEQ ID NO: 219).

11. The anti-CD22 construct of embodiment 10, wherein the light chain variable region comprises the sequence of SEQ ID NO: 218, and the heavy chain variable region comprises the sequence of SEQ ID NO: 219.

12. The anti-CD22 construct of embodiment 1, wherein the antibody moiety comprises one or more of:
the LC-CDR1 having a sequence of SSNIGNNY (SEQ ID NO: 206),
the LC-CDR2 having a sequence of ENN (SEQ ID NO: 207),
the LC-CDR3 having a sequence of GTWDSSL-SAGAV (SEQ ID NO: 208),
the HC-CDR1 having a sequence of GFTFSNYA (SEQ ID NO: 209),
the HC-CDR2 having a sequence of ISGSGGST (SEQ ID NO: 210), and
the HC-CDR3 having a sequence of ARPYYDD (SEQ ID NO: 211).

13. The anti-CD22 construct of embodiment 12, wherein the antibody moiety comprises the sequences of SEQ ID NOS: 206-211.

14. The anti-CD22 construct of embodiment 12 or 13, wherein the light chain variable region has a sequence having at least 90% identity to the sequence of QSVVTQPPSVSAAPGQKVTISCSGSSS-NIGNNYVSWYQQLPGTAPKLLIYENNKRPSG IPDRFSGSKSGTSATLGITGLQTGDEAD-YYCGTWDSSLSAGAVFGGGTKLTVLG (SEQ ID NO: 212).

15. The anti-CD22 construct of any one of embodiments 12 or 13, wherein the heavy chain variable region has a sequence having at least 90% identity to the sequence of EVQLVESGGGLVQPGGSLRLS-CAASGFTFSNYAMSWVRQAPGKGLEWVSAIS-GSGG STYYAD SVKGRFTISRDNSKNT-LYLQMNSLRAEDTAVYYCARPYYDDWGQGTLVT VSS (SEQ ID NO: 213).

16. An anti-CD22 construct comprising a heavy chain variable region and a light chain variable region and, wherein
the light chain variable region has a sequence having at least 90% identity to the sequence of QSVVTQPPSVSAAPGQKVTISCSGSSS-NIGNNYVSWYQQLPGTAPKLLIYENNKRPSG IPDRFSGSKSGTSATLGITGLQTGDEAD-YYCGTWDSSLSAGAVFGGGTKLTVLG (SEQ ID NO: 212), and
the heavy chain variable region has a sequence having at least 90% identity to the sequence of EVQLVES-GGGLVQPGGSLRLSCAASGFTFSNYAM-SWVRQAPGKGLEWVSAISGSGG STYY-ADSVKGRFTISRDNSKNTLYLQMNSLRAE DTAVYYCARPYYDDWGQGTLVT VSS (SEQ ID NO: 213).

17. The anti-CD22 construct of embodiment 16, wherein the light chain variable region comprises the sequence of SEQ ID NO: 212, and the heavy chain variable region comprises the sequence of SEQ ID NO: 213.

18. An anti-CD22 construct comprising an antibody moiety that competes with the anti-CD22 construct of embodiment 11 or embodiment 17 for specific binding to CD22.

19. The anti-CD22 construct of any one of embodiments 1 to 18, wherein the light chain variable region and the heavy chain variable region are joined by a linker.

20. The anti-CD22 construct of embodiment 19, wherein the linker has the sequence of SRGGGGSGGGGSGGGGSLEMA (SEQ ID NO: 233).

21. The anti-CD22 construct of any one of embodiments 1 to 20, wherein the antibody moiety comprises a light chain of the lambda or kappa isotype.

22. The anti-CD22 construct of any one of embodiments 1 to 21, wherein the antibody moiety binds to a an extracellular region of CD22.

23. The anti-CD22 construct of embodiment 22, wherein the extracellular region of CD22 comprises at least 7 amino acids of the sequence of DVQYPPKKVTT-VIQNPM-PIREGDTVTLSCNYNSSNPSVTRYEWKPHG AWEEPSLGVL KIQNVGWDNTTIACAACNSWCS-WASPVALNVQYAPRDVRVRKIKPLSEIHSGNSVS LQCDFSSSHPKEVQFFWEKNGRLLGKESQLNFD-SISPEDAGSYSCWVNNSIGQTASK AWTLEVLY-APRRLRVSMSPGDQVMEGKSATLTCES-DANPPVSHYTWFDWNNQSLP YHSQKLRLEPVKVQHSGAYWCQGTNSVGKGR-SPLSTLTVYYSPETIGRR (SEQ ID NO: 205).

24. The anti-CD22 construct of embodiment 22 or 23, wherein the extracellular region has the sequence of SEQ ID NO: 205.
25. The anti-CD22 construct of any one of embodiments 1 to 24, wherein the construct is a full-length antibody, a Fab, a Fab', a F(ab')2, an Fv, a single chain Fv (scFv) antibody.
26. The anti-CD22 construct of any one of embodiments 1 to 25, wherein the construct is monospecific.
27. The anti-CD22 construct of any one of embodiments 1 to 25, wherein the construct is multispecific.
28. The anti-CD22 construct of embodiment 27, wherein the construct is bispecific.
29. The anti-CD22 construct of embodiment 27 or 28, wherein the construct is a tandem scFv, a diabody (Db), a single chain diabody (scDb), a dual-affinity retargeting (DART) antibody, a dual variable domain (DVD) antibody, a knob-into-hole (KiH) antibody, a dock and lock (DNL) antibody, a chemically cross-linked antibody, a heteromultimeric antibody, or a heteroconjugate antibody.
30. The anti-CD22 construct of embodiment 25, wherein the construct is a tandem scFv comprising two scFvs linked by a peptide linker.
31. The anti-CD22 construct of embodiment 30, wherein the peptide linker comprises the amino acid sequence of SEQ ID NO: 233.
32. The anti-CD22 construct of any one of embodiments 27 to 31, wherein the construct further comprises a second antibody moiety that specifically binds to a second antigen.
33. The anti-CD22 construct of embodiment 32, wherein the second antigen is an antigen on the surface of a T cell.
34. The anti-CD22 construct of embodiment 33, wherein the T cell is selected from the group consisting of a cytotoxic T cell, a helper T cell, and a natural killer T cell.
35. The anti-CD22 construct of any one of embodiments 32 to 34, wherein the second antigen is selected from the group consisting of CD3γ, CD3δ, CD3ε, CD3ζ, CD28, CD16a, CD56, CD68, GDS2D, OX40, GITR, CD137, CD27, CD40L and HVEM.
36. The anti-CD22 construct of embodiment 35, wherein the second antigen is CD3ε, and wherein the construct is a tandem scFv comprising an N-terminal scFv specific for CD22 having the sequence of SEQ ID NO: 205 or a portion thereof and a C-terminal scFv specific for CD3ε.
37. The anti-CD22 construct of embodiment 32, wherein the second antigen is an antigen on the surface of a natural killer cell, a neutrophil, a monocyte, a macrophage or a dendritic cell.
38. The anti-CD22 construct of any one of embodiments 1 to 24, wherein the anti-CD22 construct is a chimeric antigen receptor (CAR).
39. The anti-CD22 construct of embodiment 38, wherein the CAR comprises an anti-CD22 antibody moiety, a transmembrane domain, and an immune cell signaling domain, wherein the anti-CD22 antibody moiety is a scFv comprising the LC-CDR1, the LC-CDR2, and the LC-CDR3 having the sequences of SEQ ID NOS: 214-216, respectively, the HC-CDR1, the HC-CDR2, and the HC-CDR3 having the sequences of SEQ ID NOS: 209, 210, and 217, respectively.
40. The anti-CD22 construct of embodiment 38, wherein the CAR comprises an anti-CD22 antibody moiety, a transmembrane domain, and an immune cell signaling domain, wherein the anti-CD22 antibody moiety is a scFv comprising the LC-CDR1, the LC-CDR2, and the LC-CDR3 having the sequences of SEQ ID NOS: 206-208, respectively, the HC-CDR1, the HC-CDR2, and the HC-CDR3 having the sequences of SEQ ID NOS: 209-211, respectively.
41. The anti-CD22 construct of embodiment 39 or 40, wherein the immune cell signaling domain is from a CD3ζ chain.
42. The anti-CD22 construct of embodiment 39 or 40, wherein the immune cell signaling domain is from CD28, 4-1BB, ICOS, or OX40.
43. The anti-CD22 construct of any one of embodiments 39 or 40, wherein the transmembrane domain is a T cell receptor transmembrane domain.
44. The anti-CD22 construct of any one of embodiments 1 to 24, wherein the anti-CD22 construct is a chimeric antibody-T cell receptor (caTCR) comprising an extracellular domain that binds to CD22 and a T cell receptor (TCR) module (TCRM) comprising TCR transmembrane domains.
45. The anti-CD22 construct of embodiment 44, wherein the caTCR comprises LC-CDR1, LC-CDR2, and LC-CDR3 having the sequences of SEQ ID NOS: 214-216, respectively, and HC-CDR1, HC-CDR2, and HC-CDR3 having the sequences of SEQ ID NOS: 209, 210, and 217, respectively.
46. The anti-CD22 construct of embodiment 44, wherein the caTCR comprises LC-CDR1, LC-CDR2, and LC-CDR3 having the sequences of SEQ ID NOS: 206-208, respectively, and HC-CDR1, HC-CDR2, and HC-CDR3 having the sequences of SEQ ID NOS: 209-211, respectively.
47. The anti-CD22 construct of any one of embodiments 44 to 46, wherein the TCRM is capable of recruiting at least one TCR-associated signaling module.
48. The anti-CD22 construct of embodiment 47, wherein the TCR-associated signaling module is selected from the group consisting of CD3δε, CD3γε, and CD3ζ.
49. The anti-CD22 construct of any one of embodiments 44 to 48, wherein the extracellular domain comprises:
    (a) a first polypeptide comprising a first antigen-binding region comprising a heavy chain variable region (VH) and a CH1 constant domain; and
    (b) a second polypeptide chain comprising a second antigen-binding region comprising a light chain variable region (VL) and a CL constant domain,
    wherein the VH and the CH1 constant domain of the first antigen-binding region and the VL and the CL constant domain of the second antigen-binding region form a Fab-like antigen-binding module that specifically binds to CD22.
50. The anti-CD22 construct of any one of embodiments 44 to 49, wherein the extracellular domain comprises a scFv that specifically binds to CD22.
51. The anti-CD22 construct of any one of embodiments 44 to 50, wherein the extracellular domain further comprises at least one additional antibody moiety that specifically binds to at least one non-CD22 antigen.
52. The anti-CD22 construct of embodiment 51, wherein the at least one non-CD22 antigen is expressed in B-cell malignancy.
53. The anti-CD22 construct of any one of embodiments 44 to 50, wherein the extracellular domain further comprises an antibody moiety that specifically binds to CD19.

54. The anti-CD22 construct of any one of embodiments 44 to 50, wherein the extracellular domain further comprises an antibody moiety that specifically binds to CD20.
55. The anti-CD22 construct of any one of embodiments 44 to 50, wherein the extracellular domain further comprises an antibody moiety that specifically binds to CD19 and an antibody moiety that specifically binds to CD20.
56. The anti-CD22 construct of any one of embodiments 44 to 55, wherein the caTCR is expressed in combination with a chimeric signaling receptor (CSR).
57. The anti-CD22 construct of embodiment 56, wherein the CSR comprises an anti-CD22 antibody moiety.
58. The anti-CD22 construct of embodiment 56, wherein the CSR comprises an antibody moiety that specifically binds a non-CD22 antigen.
59. The anti-CD22 construct of any one of embodiments 1 to 24, wherein the anti-CD22 construct is a chimeric signaling receptor (CSR).
60. The anti-CD22 construct of embodiment 59, wherein the CSR comprises
    (a) an anti-CD22 antibody moiety;
    (b) a transmembrane module; and
    (c) a co-stimulatory immune cell signaling module that is capable of providing a co-stimulatory signal to the immune cell,
    wherein the CSR lacks a functional primary immune cell signaling domain.
61. The anti-CD22 construct of embodiment 60, wherein the anti-CD22 antibody moiety comprises the LC-CDR1, the LC-CDR2, and the LC-CDR3 having the sequences of SEQ ID NOS: 214-216, respectively, the HC-CDR1, the HC-CDR2, and the HC-CDR3 having the sequences of SEQ ID NOS: 209, 210, and 217, respectively.
62. The anti-CD22 construct of embodiment 60, wherein the anti-CD22 antibody moiety comprises the LC-CDR1, the LC-CDR2, and the LC-CDR3 having the sequences of SEQ ID NOS: 206-208, respectively, the HC-CDR1, the HC-CDR2, and the HC-CDR3 having the sequences of SEQ ID NOS: 209-211, respectively.
63. The anti-CD22 construct of any one of embodiments 59 to 62, wherein the CSR is expressed in combination with a caTCR or CAR.
64. The anti-CD22 construct of embodiment 63, wherein the caTCR or CAR specifically targets CD22.
65. The anti-CD22 construct of embodiment 63, wherein the caTCR or CAR does not specifically target CD22.
66. The anti-CD22 construct of any one of embodiments 59 to 65, wherein the CSR further comprises at least one additional antibody moiety that specifically binds to at least one non-CD22 antigen.
67. The anti-CD22 construct of any one of embodiments 56 to 66, wherein the CSR further comprises an antibody moiety that specifically binds to CD19.
68. The anti-CD22 construct of any one of embodiments 56 to 67, wherein the CSR further comprises an antibody moiety that specifically binds to CD20.
69. The anti-CD22 construct of any one of embodiments 56 to 68, wherein the CSR comprises a transmembrane fragment and an intracellular fragment that are from the same molecule.
70. The anti-CD22 construct of embodiment 69, wherein the molecule is selected from the group consisting of CD28, 4-1BB (CD137), OX40, CD30, CD27, CD40, PD-1, ICOS, lymphocyte function-associated antigen-1 (LFA-1), CD2, CD7, LIGHT, NKG2C, B7-H3, and a ligand that specifically binds with CD83.
71. The anti-CD22 construct of embodiment 70, wherein the molecule is selected from the group consisting of CD28, 4-1BB (CD137), OX40, CD30, and CD27.
72. The anti-CD22 construct of any one of embodiments 56 to 68, wherein the CSR comprises a transmembrane fragment and an intracellular fragment that are from different molecules.
73. The anti-CD22 construct of embodiment 72, wherein the CSR comprises a transmembrane fragment of a molecule selected from the group consisting of the α, β, δ, γ, or ζ chain of the T-cell receptor, CD28, CD3ε, CD3, CD45, CD4, CD5, CD8, CD9, CD16, CD22, CD33, CD37, CD64, CD80, CD86, CD134, CD137, and CD154.
74. The anti-CD22 construct of embodiment 74, wherein the CSR comprises a transmembrane fragment of CD8, 4-1BB, CD27, CD28, CD30, or OX40.
75. The anti-CD22 construct of any one of embodiments 72 to 75, wherein the transmembrane fragment comprises a sequence of any one of SEQ ID NOS: 145-150.
76. The anti-CD22 construct of any one of embodiments 72 to 75, wherein the CSR comprises an intracellular fragment of a molecule selected from the group consisting of CD28, 4-1BB (CD137), OX40, CD30, CD27, CD40, PD-1, ICOS, lymphocyte function-associated antigen-1 (LFA-1), CD2, CD7, LIGHT, NKG2C, B7-H3, and a ligand that specifically binds with CD83.
77. The anti-CD22 construct of embodiment 76, wherein the CSR comprises an intracellular fragment of a molecule selected from the group consisting of CD28, 4-1BB (CD137), OX40, CD30, and CD27.
78. The anti-CD22 construct of embodiment 76, wherein the intracellular fragment comprises a sequence of any one of SEQ ID NOS: 151-155.
79. The anti-CD22 construct of any one of embodiments 56 to 78, wherein the CSR comprises a sequence of any one of SEQ ID NOS: 156-171.
80. The anti-CD22 construct of any one of embodiments 1 to 24, wherein the anti-CD22 construct is an immunoconjugate comprising the antibody moiety and an effector molecule.
81. The anti-CD22 construct of embodiment 80, wherein the effector molecule is a therapeutic agent selected from the group consisting of a drug, a toxin, a radioisotope, a protein, a peptide, and a nucleic acid.
82. The anti-CD22 construct of embodiment 81, wherein the therapeutic agent is a drug or a toxin.
83. The anti-CD22 construct of embodiment 80, wherein the effector molecule is a label.
84. A nucleic acid molecule encoding one or more polypeptides contained in the anti-CD22 construct of any one of embodiments 1 to 83.
85. The nucleic acid molecule of embodiment 84, wherein the nucleic acid molecule encodes all of the polypeptides contained in the anti-CD22 construct of any one of embodiments 1 to 83.
86. The nucleic acid molecule of embodiment 85, wherein:
the anti-CD22 construct is a caTCR and is expressed in combination with a CSR, and wherein the nucleic acid molecule encodes all of the polypeptides contained in the caTCR and the polypeptide of the CSR; or
the anti-CD22 construct is a CSR and is expressed in combination with a caTCR or CAR, and wherein the nucleic acid molecule encodes the polypeptide of the CSR and all of the polypeptides contained in the caTCR or CAR.
87. A set of nucleic acid molecules encoding all of the polypeptides contained in the anti-CD22 construct of any one of embodiments 1 to 83 separately.
88. The set of nucleic acid molecules of embodiment 87, wherein:
the anti-CD22 construct is a caTCR and is expressed in combination with a CSR, and wherein the set of nucleic acid molecules encode all of the polypeptides contained in the caTCR and the polypeptide of the CSR; or
the anti-CD22 construct is a CSR and is expressed in combination with a caTCR or CAR, and wherein the set of nucleic acid molecules encode the polypeptide of the CSR and all of the polypeptides contained in the caTCR or CAR.
89. An expression cassette comprising the nucleic acid molecule of any one of embodiments 84 to 86.
90. A set of expression cassettes comprising nucleic acid molecules encoding all of the polypeptides contained in the anti-CD22 construct of any one of embodiments 1 to 83 separately.
91. The set of expression cassettes of embodiment 90, wherein the set of expression cassettes comprise the set of nucleic acid molecules of embodiment 87 or 88.
92. A host cell comprising the nucleic acid molecule of any one of embodiments 84 to 86, the set of nucleic acid molecules of embodiment 87 or 88, the expression cassette of embodiment 89, or the set of expression cassettes of embodiment 90 or 91.
93. A host cell expressing the anti-CD22 construct of any one of embodiments 1 to 83.
94. The host cell of embodiment 93, wherein the host cell comprises the nucleic acid molecule of any one of embodiments 84 to 86, the set of nucleic acid molecules of embodiment 87 or 88, the expression cassette of embodiment 89, or the set of expression cassettes of embodiment 90 or 91.
95. A method of preparing an anti-CD22 construct of any one of embodiments 1 to 83, wherein said method comprising:
(a) providing a host cell comprising the nucleic acid molecule of any one of embodiments 84 to 86, the set of nucleic acid molecules of embodiment 87 or 88, the expression cassette of embodiment 89, or the set of expression cassettes of embodiment 90 or 91, and
(b) expressing the nucleic acid molecule(s) or expression cassette(s) in the host cell under conditions that allow for the formation of the anti-CD22 construct.
96. A pharmaceutical composition comprising a therapeutically effective amount of the anti-CD22 construct of any one of embodiments 1 to 83, the nucleic acid molecule of any one of embodiments 84 to 86, the set of nucleic acid molecules of embodiment 87 or 88, the expression cassette of embodiment 89, the set of expression cassettes of embodiment 90 or 91, or the host cell of any one of embodiments 92 to 94, and one or more pharmaceutically acceptable carriers or excipients.
97. A method of treating a B-cell malignancy in a subject in need thereof, comprising administering to the subject a therapeutically effective amount of the anti-CD22 construct of any one of embodiments 1 to 83, the nucleic acid molecule of any one of embodiments 84 to 86, the set of nucleic acid molecules of embodiment 87 or 88, the expression cassette of embodiment 89, the set of expression cassettes of embodiment 90 or 91, the host cell of any one of embodiments 92 to 94, or the pharmaceutical composition of embodiment 96.
98. A method of treating a disease or disorder characterized by CD22 overexpression in a subject in need thereof, comprising administering to the subject a therapeutically effective amount of the anti-CD22 construct of any one of embodiments 1 to 83, the nucleic acid molecule of any one of embodiments 84 to 86, the set of nucleic acid molecules of embodiment 87 or 88, the expression cassette of embodiment 89, the set of expression cassettes of embodiment 90 or 91, the host cell of any one of embodiments 92 to 94, or the pharmaceutical composition of embodiment 96. In some embodiments of this method, the method is a method of treating a disease. In some embodiments, the method is a method of treating a disorder. In some embodiments, the disease or disorder characterized by CD22 overexpression is cancer (e.g., B-cell malignancy).
99. A method of treatment comprising introducing the nucleic acid molecule of any one of embodiments 84 to 86, the set of nucleic acid molecules of embodiment 87 or 88, the expression cassette of embodiment 89, or the set of expression cassettes of embodiment 90 or 91 into one or more primary cells isolated from a subject and administering cells comprising the nucleic acid molecule, the set of nucleic acid molecules, the expression cassette, or the set of expression cassettes to the subject.
100. The method of embodiment 99, further comprising expanding the cells prior to administering the cells to the subject.
101. The method embodiment 99 or 100, wherein the primary cells are lymphocytes.
102. The method of embodiment 101, wherein the primary cells are T cells.
103. A method of detecting CD22 in a sample, comprising: (a) contacting the sample with the anti-CD22 construct of any one of embodiments 1 to 26; and (b) detecting the binding, directly or indirectly, between the anti-CD22 construct and any CD22 in the sample.
104. The method of embodiment 103, wherein the anti-CD22 construct is conjugated to a detectable label.
105. The method of embodiment 104, wherein the detectable label is a chromogenic, enzymatic, radioisotopic, isotopic, fluorescent, toxic, chemiluminescent, nuclear magnetic resonance contrast agent.
106. The method of embodiment 104 or 105, wherein the binding between the anti-CD22 construct and any CD22 in the sample is detected directly by detecting the detectable label.
107. The method of embodiment 103, wherein the binding between the anti-CD22 construct and any CD22 in the sample is detected indirectly using a secondary antibody.
108. A method of diagnosing a subject suspected of having a CD22-associated disease or disorder, comprising:
a) administering an effective amount of the anti-CD22 construct of any one of embodiments 1 to 26 to the subject; and
b) determining the level of the binding, directly or indirectly, between the anti-CD22 construct and any CD22 in the subject, wherein a level of the binding above a threshold level indicates that the subject has the CD22-associated disease or disorder.

109. The method of embodiment 108, wherein the CD22-associated disease or disorder is cancer.
110. The method of embodiment 109, wherein the cancer is a B-cell malignancy.
111. A method of diagnosing a subject having a B-cell malignancy, comprising:
   (a) contacting a sample derived from the subject with the anti-CD22 construct of any one of embodiments 1 to 26; and
   (b) determining the number of cells bound with the anti-CD22 construct in the sample,
      wherein a value for the number of cells bound with the anti-CD22 construct above a threshold level indicates that the subject has the B-cell malignancy.
112. The method of embodiment 111, wherein the B-cell malignancy is a CD22+ B-cell malignancy.
113. The method of any one of embodiments 98, 108, and 111, wherein the disease, disorder, or B-cell malignancy is a B-cell lymphoma or a B-cell leukemia.
114. The method of any one of embodiments 97 to 113, wherein the subject is a human.
115. Use of the anti-CD22 construct of any one of embodiments 1 to 83, the nucleic acid molecule of any one of embodiments 84 to 86, the set of nucleic acid molecules of embodiment 87 or 88, the expression cassette of embodiment 89, the set of expression cassettes of embodiment 90 or 91, the host cell of any one of embodiments 92 to 94, or the pharmaceutical composition of embodiment 96 for the treatment of a disease or disorder associated with positive CD22 expression.
116. Use of the anti-CD22 construct of any one of embodiments 1 to 83, the nucleic acid molecule of any one of embodiments 84 to 86, the set of nucleic acid molecules of embodiment 87 or 88, the expression cassette of embodiment 89, the set of expression cassettes of embodiment 90 or 91, the host cell of any one of embodiments 92 to 94, or the pharmaceutical composition of embodiment 96 in the manufacture of a medicament for the treatment of a disease or disorder associated with positive CD22 expression.
117. Use of the anti-CD22 construct of any one of embodiments 1 to 26 for the diagnosis of a disease or disorder associated with positive CD22 expression.
118. The use of any one of embodiments 115 to 117, wherein the disease or disorder associated with positive CD22 expression is a cancer.

INFORMAL SEQUENCE LISTING

| SEQ ID NO. | Sequence | Notes |
|---|---|---|
| 1 | METDTLLLWVLLLWVPGSTGEVQLVQSGAEVKKPGESLKISCKGSGYSFTS YWIGWVRQMPGKGLEWMGIIYPGDSDTRYSPSFQGQVTISADKSISTAYLQ WSSLKASDTAMYYCARQVWGWQGGMYPRSNWWYNLDSWGQGTLVTVSS ASTKGPSVFPLAPSSKSTSGGTAALGCLVKDYFPEPVTVSWNSGALTSGVHT FPAVLQSSGLYSLSSVVTVPSSSLGTQTYICNVNHKPSNTKVDKRVEPKSCEV KTDSTDHVKPKETENTKQPSKSCHKPKAIVHTEKVNMMSLTVLGLRMLFAK TVAVNFLLTAKLFFLRAKRSGSGAPVKQTLNFDLLKLAGDVESNPGPMETD TLLLWVLLLWVPGSTGLPVLTQPPSVSVAPGKTARITCGGNNIGSKSVHWY QQKPGQAPVLVVYDDSDRPSGIPERFSGSNSGNTATLTISRVEAGDEADYYC QVWDSSSDYVVFGGGTKLTVLGQPKANPTVTLFPPSSEELQANKATLVCLIS DFYPGAVTVAWKADGSPVKAGVETTKPSKQSNNKYAASSYLSLTPEQWKS HRSYSCQVTHEGSTVEKTVAPTECSPIKTDVITMDPKDNCSKDANDTLLLQL TNTSAYYMYLLLLLKSVVYFAIITCCLLRRTAFCCNGEKSGSGATNFSLLKQ AGDVEENPGPMETDTLLLWVLLLWVPGSTGLPVLTQPPSVSVAPGKTARITC GGNNIGSKSVHWYQQKPGQAPVLVVYDDSDRPSGIPERFSGSNSGNTATLTI SRVEAGDEADYYCQVWDSSSDYVVFGGGTKLTVLGSRGGGGSGGGGSGGG GSLEMAEVQLVQSGAEVKKPGESLKISCKGSGYSFTSYWIGWVRQMPGKGL EWMGIIYPGDSDTRYSPSFQGQVTISADKSISTAYLQWSSLKASDTAMYYCA RQVWGWQGGMYPRSNWWYNLDSWGQGTLVTVSSAAAIEVMYPPPYLDN EKSNGTIIHVKGKHLCPSPLFPGPSKPFWVLVVVGGVLACYSLLVTVAFIIFW VRSKRSRLLHSDYMNMTPRRPGPTRKHYQPYAPPRDFAAYRS | Construct combination 1 (anti-CD19-caTCR + anti-CD19-CSR_1) |
| 2 | METDTLLLWVLLLWVPGSTGQVQLVESGGGLVQPGGSLRLSCAASGFTFSN YAMSWVRQAPGKGLEWVSSISGSGGSTYYADSVKGRFTISRDTSKNTLYLQ MNSLRAEDTAVYYCARYGSAAWMDSWGQGTLVTVSSASTKGPSVFPLAPS SKSTSGGTAALGCLVKDYFPEPVTVSWNSGALTSGVHTFPAVLQSSGLYSLS SVVTVPSSSLGTQTYICNVNHKPSNTKVDKRVEPKSCEVKTDSTDHVKPKET ENTKQPSKSCHKPKAIVHTEKVNMMSLTVLGLRMLFAKTVAVNFLLTAKLF FLRAKRSGSGAPVKQTLNFDLLKLAGDVESNPGPMETDTLLLWVLLLWVPG STGDIQLTQSPSSLSTSVGDRVTITCQASHDIRNYLNWYQQKPGKAPNLLIYA ASNLQTGVPSRFSGRGSGTDFTLTISSLQPEDIATYYCQQYDGLPLTFGQGTR LEIKRTVAAPSVFIFPPSDEQLKSGTASVVCLLNNFYPREAKVQWKVDNALQ SGNSQESVTEQDSKDSTYSLSSTLTLSKADYEKHKVYACEVTHQGLSSPVTK SFNRGECPIKTDVITMDPKDNCSKDANDTLLLQLTNTSAYYMYLLLLLKSVV YFAIITCCLLRRTAFCCNGEKS | Construct 2 (anti-CD22-caTCR) |
| 3 | METDTLLLWVLLLWVPGSTGQVQLVESGGGLVQPGGSLRLSCAASGFTFSN YAMSWVRQAPGKGLEWVSSISGSGGSTYYADSVKGRFTISRDTSKNTLYLQ MNSLRAEDTAVYYCARYGSAAWMDSWGQGTLVTVSSASTKGPSVFPLAPS SKSTSGGTAALGCLVKDYFPEPVTVSWNSGALTSGVHTFPAVLQSSGLYSLS SVVTVPSSSLGTQTYICNVNHKPSNTKVDKRVEPKSCEVKTDSTDHVKPKET ENTKQPSKSCHKPKAIVHTEKVNMMSLTVLGLRMLFAKTVAVNFLLTAKLF FLRAKRSGSGAPVKQTLNFDLLKLAGDVESNPGPMETDTLLLWVLLLWVPG STGDIQLTQSPSSLSTSVGDRVTITCQASHDIRNYLNWYQQKPGKAPNLLIYA ASNLQTGVPSRFSGRGSGTDFTLTISSLQPEDIATYYCQQYDGLPLTFGQGTR | Construct combination 3 (anti-CD22-caTCR + anti-CD19-CSR_1) |

| SEQ ID NO. | Sequence | Notes |
|---|---|---|
| | LEIKRTVAAPSVFIFPPSDEQLKSGTASVVCLLNNFYPREAKVQWKVDNALQ<br>SGNSQESVTEQDSKDSTYSLSSTLTLSKADYEKHKVYACEVTHQGLSSPVTK<br>SFNRGECPIKTDVITMDPKDNCSKDANDTLLLQLTNTSAYYMYLLLLLKSVV<br>YFAIITCCLLRRTAFCCNGEKSGSGATNFSLLKQAGDVEENPGPMETDTLLL<br>WVLLLWVPGSTGLPVLTQPPSVSVAPGKTARITCGGNNIGSKSVHWYQQKP<br>GQAPVLVVYDDSDRPSGIPERFSGSNSGNTATLTISRVEAGDEADYYCQVW<br>DSSSDYVVFGGGTKLTVLGSRGGGGSGGGGSGGGGSLEMAEVQLVQSGAE<br>VKKPGESLKISCKGSGYSFTSYWIGWVRQMPGKGLEWMGIIYPGDSDTRYSP<br>SFQGQVTISADKSISTAYLQWSSLKASDTAMYYCARQVWGWQGGMYPRSN<br>WWYNLDSWGQGTLVTVSSAAAIEVMYPPPYLDNEKSNGTIIHVKGKHLCPS<br>PLFPGPSKPFWVLVVVGGVLACYSLLVTVAFIIFWVRSKRSRLLHSDYMNMT<br>PRRPGPTRKHYQPYAPPRDFAAYRS | |
| 4 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSQVQLVESGGGLVQPGGSLRLSCAASGFTFSNYAMSWV<br>RQAPGKGLEWVSSISGSGGSTYYADSVKGRFTISRDTSKNTLYLQMNSLRAE<br>DTAVYYCARYGSAAWMDSWGQGTLVTVSSASTKGPSVFPLAPSSKSTSGGT<br>AALGCLVKDYFPEPVTVSWNSGALTSGVHTFPAVLQSSGLYSLSSVVTVPSS<br>SLGTQTYICNVNHKPSNTKVDKRVEPKSCEVKTDSTDHVKPKETENTKQPSK<br>SCHKPKAIVHTEKVNMMSLTVLGLRMLFAKTVAVNFLLTAKLFFLRAKRSG<br>SGAPVKQTLNFDLLKLAGDVESNPGPMETDTLLLWVLLLWVPGSTGDIQLT<br>QSPSSLSTSVGDRVTITCQASHDIRNYLNWYQQKPGKAPNLLIYAASNLQTG<br>VPSRFSGRGSGTDFTLTISSLQPEDIATYYCQQYDGLPLTFGQGTRLEIKRTVA<br>APSVFIFPPSDEQLKSGTASVVCLLNNFYPREAKVQWKVDNALQSGNSQESV<br>TEQDSKDSTYSLSSTLTLSKADYEKHKVYACEVTHQGLSSPVTKSFNRGECPI<br>KTDVITMDPKDNCSKDANDTLLLQLTNTSAYYMYLLLLLKSVVYFAIITCCL<br>LRRTAFCCNGEKS | Construct 4<br>(anti-CD22-scFv-<br>anti-CD22-caTCR) |
| 5 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSQVQLVESGGGLVQPGGSLRLSCAASGFTFSNYAMSWV<br>RQAPGKGLEWVSSISGSGGSTYYADSVKGRFTISRDTSKNTLYLQMNSLRAE<br>DTAVYYCARYGSAAWMDSWGQGTLVTVSSASTKGPSVFPLAPSSKSTSGGT<br>AALGCLVKDYFPEPVTVSWNSGALTSGVHTFPAVLQSSGLYSLSSVVTVPSS<br>SLGTQTYICNVNHKPSNTKVDKRVEPKSCEVKTDSTDHVKPKETENTKQPSK<br>SCHKPKAIVHTEKVNMMSLTVLGLRMLFAKTVAVNFLLTAKLFFLRAKRSG<br>SGAPVKQTLNFDLLKLAGDVESNPGPMETDTLLLWVLLLWVPGSTGDIQLT<br>QSPSSLSTSVGDRVTITCQASHDIRNYLNWYQQKPGKAPNLLIYAASNLQTG<br>VPSRFSGRGSGTDFTLTISSLQPEDIATYYCQQYDGLPLTFGQGTRLEIKRTVA<br>APSVFIFPPSDEQLKSGTASVVCLLNNFYPREAKVQWKVDNALQSGNSQESV<br>TEQDSKDSTYSLSSTLTLSKADYEKHKVYACEVTHQGLSSPVTKSFNRGECPI<br>KTDVITMDPKDNCSKDANDTLLLQLTNTSAYYMYLLLLLKSVVYFAIITCCL<br>LRRTAFCCNGEKSGSGATNFSLLKQAGDVEENPGPMETDTLLLWVLLLWVP<br>GSTGLPVLTQPPSVSVAPGKTARITCGGNNIGSKSVHWYQQKPGQAPVLVV<br>YDDSDRPSGIPERFSGSNSGNTATLTISRVEAGDEADYYCQVWDSSSDYVVF<br>GGGTKLTVLGSRGGGGSGGGGSGGGGSLEMAEVQLVQSGAEVKKPGESLKI<br>SCKGSGYSFTSYWIGWVRQMPGKGLEWMGIIYPGDSDTRYSPSFQGQVTISA<br>DKSISTAYLQWSSLKASDTAMYYCARQVWGWQGGMYPRSNWWYNLDSW<br>GQGTLVTVSSEQKLISEEDLAAAIEVMYPPPYLDNEKSNGTIIHVKGKHLCPS<br>PLFPGPSKPFWVLVVVGGVLACYSLLVTVAFIIFWVRSKRSRLLHSDYMNMT<br>PRRPGPTRKHYQPYAPPRDFAAYRS | Construct<br>combination 5<br>(anti-CD22-scFv-<br>anti-CD22-caTCR +<br>anti-CD19-CSR_1) |
| 6 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSQVQLVESGGGLVQPGGSLRLSCAASGFTFSNYAMSWV<br>RQAPGKGLEWVSSISGSGGSTYYADSVKGRFTISRDTSKNTLYLQMNSLRAE<br>DTAVYYCARYGSAAWMDSWGQGTLVTVSSASTKGPSVFPLAPSSKSTSGGT<br>AALGCLVKDYFPEPVTVSWNSGALTSGVHTFPAVLQSSGLYSLSSVVTVPSS<br>SLGTQTYICNVNHKPSNTKVDKRVEPKSCEVKTDSTDHVKPKETENTKQPSK<br>SCHKPKAIVHTEKVNMMSLTVLGLRMLFAKTVAVNFLLTAKLFFLRAKRSG<br>SGAPVKQTLNFDLLKLAGDVESNPGPMETDTLLLWVLLLWVPGSTGDIQLT<br>QSPSSLSTSVGDRVTITCQASHDIRNYLNWYQQKPGKAPNLLIYAASNLQTG<br>VPSRFSGRGSGTDFTLTISSLQPEDIATYYCQQYDGLPLTFGQGTRLEIKRTVA<br>APSVFIFPPSDEQLKSGTASVVCLLNNFYPREAKVQWKVDNALQSGNSQESV<br>TEQDSKDSTYSLSSTLTLSKADYEKHKVYACEVTHQGLSSPVTKSFNRGECPI | Construct<br>combination 6<br>(anti-CD22-scFv-<br>anti-CD22-caTCR +<br>anti-CD22-CSR_1) |

| SEQ ID NO. | Sequence | Notes |
|---|---|---|
| | KTDVITMDPKDNCSKDANDTLLLQLTNTSAYYMYLLLLLKSVVYFAIITCCL LRRTAFCCNGEKSGSGATNFSLLKQAGDVEENPGPMETDTLLLWVLLLWVP GSTGDIQLTQSPSSLSTSVGDRVTITCQASHDIRNYLNWYQQKPGKAPNLLIY AASNLQTGVPSRFSGRGSGTDFTLTISSLQPEDIATYYCQQYDGLPLTFGQGT RLEIKRSRGGGGSGGGGSGGGGSLEMAQVQLVESGGGLVQPGGSLRLSCAA SGFTFSNYAMSWVRQAPGKGLEWVSSISGSGGSTYYADSVKGRFTISRDTSK NTLYLQMNSLRAEDTAVYYCARYGSAAWMDSWGQGTLVTVSSEQKLISEE DLAAAIEVMYPPPYLDNEKSNGTIIHVKGKHLCPSPLFPGPSKPFWVLVVVG GVLACYSLLVTVAFIIFWVRSKRSRLLHSDYMNMTPRRPGPTRKHYQPYAPP RDFAAYRS | |
| 7 | METDTLLLWVLLLWVPGSTGDIQLTQSPSSLSTSVGDRVTITCQASHDIRNYL NWYQQKPGKAPNLLIYAASNLQTGVPSRFSGRGSGTDFTLTISSLQPEDIATY YCQQYDGLPLTFGQGTRLEIKRSRGGGGSGGGGSGGGGSLEMAQVQLVESG GGLVQPGGSLRLSCAASGFTFSNYAMSWVRQAPGKGLEWVSSISGSGGSTY YADSVKGRFTISRDTSKNTLYLQMNSLRAEDTAVYYCARYGSAAWMDSWG QGTLVTVSSGGGGSQVQLVESGGGLVQPGGSLRLSCAASGFTFSNYAMSWV RQAPGKGLEWVSSISGSGGSTYYADSVKGRFTISRDTSKNTLYLQMNSLRAE DTAVYYCARYGSAAWMDSWGQGTLVTVSSASTKGPSVFPLAPSSKSTSGGT AALGCLVKDYFPEPVTVSWNSGALTSGVHTFPAVLQSSGLYSLSSVVTVPSS SLGTQTYICNVNHKPSNTKVDKRVEPKSCEVKTDSTDHVKPKETENTKQPSK SCHKPKAIVHTEKVNMMSLTVLGLRMLFAKTVAVNFLLTAKLFFLRAKRSG SGAPVKQTLNFDLLKLAGDVESNPGPMETDTLLLWVLLLWVPGSTGDIQLT QSPSSLSTSVGDRVTITCQASHDIRNYLNWYQQKPGKAPNLLIYAASNLQTG VPSRFSGRGSGTDFTLTISSLQPEDIATYYCQQYDGLPLTFGQGTRLEIKRTVA APSVFIFPPSDEQLKSGTASVVCLLNNFYPREAKVQWKVDNALQSGNSQESV TEQDSKDSTYSLSSTLTLSKADYEKHKVYACEVTHQGLSSPVTKSFNRGECPI KTDVITMDPKDNCSKDANDTLLLQLTNTSAYYMYLLLLLKSVVYFAIITCCL LRRTAFCCNGEKSGSGATNFSLLKQAGDVEENPGPMETDTLLLWVLLLWVP GSTGDIQLTQSPSSLSTSVGDRVTITCQASHDIRNYLNWYQQKPGKAPNLLIY AASNLQTGVPSRFSGRGSGTDFTLTISSLQPEDIATYYCQQYDGLPLTFGQGT RLEIKRSRGGGGSGGGGSGGGGSLEMAQVQLVESGGGLVQPGGSLRLSCAA SGFTFSNYAMSWVRQAPGKGLEWVSSISGSGGSTYYADSVKGRFTISRDTSK NTLYLQMNSLRAEDTAVYYCARYGSAAWMDSWGQGTLVTVSSEQKLISEE DLAAATGTTTPAPRPPTPAPTIASQPLSLRPEACRPAAGGAVHTRGLDFACDI YIWAPLAGTCGVLLLSLVITLYCKRGRKKLLYIFKQPFMRPVQTTQEEDGCS CRFPEEEEGGCEL | Construct combination 7 (anti-CD22-scFv- anti-CD22-caTCR + anti-CD22-CSR_2) |
| 8 | METDTLLLWVLLLWVPGSTGDIQLTQSPSSLSTSVGDRVTITCQASHDIRNYL NWYQQKPGKAPNLLIYAASNLQTGVPSRFSGRGSGTDFTLTISSLQPEDIATY YCQQYDGLPLTFGQGTRLEIKRSRGGGGSGGGGSGGGGSLEMAQVQLVESG GGLVQPGGSLRLSCAASGFTFSNYAMSWVRQAPGKGLEWVSSISGSGGSTY YADSVKGRFTISRDTSKNTLYLQMNSLRAEDTAVYYCARYGSAAWMDSWG QGTLVTVSSGGGGSQVQLVESGGGLVQPGGSLRLSCAASGFTFSNYAMSWV RQAPGKGLEWVSSISGSGGSTYYADSVKGRFTISRDTSKNTLYLQMNSLRAE DTAVYYCARYGSAAWMDSWGQGTLVTVSSASTKGPSVFPLAPSSKSTSGGT AALGCLVKDYFPEPVTVSWNSGALTSGVHTFPAVLQSSGLYSLSSVVTVPSS SLGTQTYICNVNHKPSNTKVDKRVEPKSCEVKTDSTDHVKPKETENTKQPSK SCHKPKAIVHTEKVNMMSLTVLGLRMLFAKTVAVNFLLTAKLFFLRAKRSG SGAPVKQTLNFDLLKLAGDVESNPGPMETDTLLLWVLLLWVPGSTGDIQLT QSPSSLSTSVGDRVTITCQASHDIRNYLNWYQQKPGKAPNLLIYAASNLQTG VPSRFSGRGSGTDFTLTISSLQPEDIATYYCQQYDGLPLTFGQGTRLEIKRTVA APSVFIFPPSDEQLKSGTASVVCLLNNFYPREAKVQWKVDNALQSGNSQESV TEQDSKDSTYSLSSTLTLSKADYEKHKVYACEVTHQGLSSPVTKSFNRGECPI KTDVITMDPKDNCSKDANDTLLLQLTNTSAYYMYLLLLLKSVVYFAIITCCL LRRTAFCCNGEKSGSGATNFSLLKQAGDVEENPGPMETDTLLLWVLLLWVP GSTGDIQLTQSPSSLSTSVGDRVTITCQASHDIRNYLNWYQQKPGKAPNLLIY AASNLQTGVPSRFSGRGSGTDFTLTISSLQPEDIATYYCQQYDGLPLTFGQGT RLEIKRSRGGGGSGGGGSGGGGSLEMAQVQLVESGGGLVQPGGSLRLSCAA SGFTFSNYAMSWVRQAPGKGLEWVSSISGSGGSTYYADSVKGRFTISRDTSK NTLYLQMNSLRAEDTAVYYCARYGSAAWMDSWGQGTLVTVSSEQKLISEE DLAAATGPADLSPGASSVTPPAPAREPGHSPQIISFFLALTSTALLFLLFFLTLR FSVVKRGRKKLLYIFKQPFMRPVQTTQEEDGCSCRFPEEEEGGCEL | Construct combination 8 (anti-CD22-scFv- anti-CD22-caTCR + anti-CD22-CSR_3) |
| 9 | METDTLLLWVLLLWVPGSTGDIQLTQSPSSLSTSVGDRVTITCQASHDIRNYL NWYQQKPGKAPNLLIYAASNLQTGVPSRFSGRGSGTDFTLTISSLQPEDIATY YCQQYDGLPLTFGQGTRLEIKRSRGGGGSGGGGSGGGGSLEMAQVQLVESG GGLVQPGGSLRLSCAASGFTFSNYAMSWVRQAPGKGLEWVSSISGSGGSTY YADSVKGRFTISRDTSKNTLYLQMNSLRAEDTAVYYCARYGSAAWMDSWG QGTLVTVSSGGGGSQVQLVESGGGLVQPGGSLRLSCAASGFTFSNYAMSWV RQAPGKGLEWVSSISGSGGSTYYADSVKGRFTISRDTSKNTLYLQMNSLRAE DTAVYYCARYGSAAWMDSWGQGTLVTVSSASTKGPSVFPLAPSSKSTSGGT AALGCLVKDYFPEPVTVSWNSGALTSGVHTFPAVLQSSGLYSLSSVVTVPSS SLGTQTYICNVNHKPSNTKVDKRVEPKSCEVKTDSTDHVKPKETENTKQPSK SCHKPKAIVHTEKVNMMSLTVLGLRMLFAKTVAVNFLLTAKLFFLRAKRSG | Construct combination 9 (anti-CD22-scFv- anti-CD22-caTCR + anti-CD22-CSR_4) |

| SEQ ID NO. | Sequence | Notes |
|---|---|---|
|  | SGAPVKQTLNFDLLKLAGDVESNPGPMETDTLLLWVLLLWVPGSTGDIQLT<br>QSPSSLSTSVGDRVTITCQASHDIRNYLNWYQQKPGKAPNLLIYAASNLQTG<br>VPSRFSGRGSGTDFTLTISSLQPEDIATYYCQQYDGLPLTFGQGTRLEIKRTVA<br>APSVFIFPPSDEQLKSGTASVVCLLNNFYPREAKVQWKVDNALQSGNSQESV<br>TEQDSKDSTYSLSSTLTLSKADYEKHKVYACEVTHQGLSSPVTKSFNRGECPI<br>KTDVITMDPKDNCSKDANDTLLLQLTNTSAYYMYLLLLLKSVVYFAIITCCL<br>LRRTAFCCNGEKSGSGATNFSLLKQAGDVEENPGPMETDTLLLWVLLLWVP<br>GSTGDIQLTQSPSSLSTSVGDRVTITCQASHDIRNYLNWYQQKPGKAPNLLIY<br>AASNLQTGVPSRFSGRGSGTDFTLTISSLQPEDIATYYCQQYDGLPLTFGQGT<br>RLEIKRSRGGGGSGGGGSGGGGSLEMAQVQLVESGGGLVQPGGSLRLSCAA<br>SGFTFSNYAMSWVRQAPGKGLEWVSSISGSGGSTYYADSVKGRFTISRDTSK<br>NTLYLQMNSLRAEDTAVYYCARYGSAAWMDSWGQGTLVTVSSEQKLISEE<br>DLAAATGTTTPAPRPPTPAPTIASQPLSRPEACRPAAGGAVHTRGLDFACDI<br>YIWAPLAGTCGVLLLSLVITLYCQRRKYRSNKGESPVEPAEPCRYSCPREEEG<br>STIPIQEDYRKPEPACSP |  |
| 10 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSQVQLVESGGGLVQPGGSLRLSCAASGFTFSNYAMSWV<br>RQAPGKGLEWVSSISGSGGSTYYADSVKGRFTISRDTSKNTLYLQMNSLRAE<br>DTAVYYCARYGSAAWMDSWGQGTLVTVSSASTKGPSVFPLAPSSKSTSGGT<br>AALGCLVKDYFPEPVTVSWNSGALTSGVHTFPAVLQSSGLYSLSSVVTVPSS<br>SLGTQTYICNVNHKPSNTKVDKRVEPKSCEVKTDSTDHVKPKETENTKQPSK<br>SCHKPKAIVHTEKVNMMSLTVLGLRMLFAKTVAVNFLLTAKLFFLRAKRSG<br>SGAPVKQTLNFDLLKLAGDVESNPGPMETDTLLLWVLLLWVPGSTGDIQLT<br>QSPSSLSTSVGDRVTITCQASHDIRNYLNWYQQKPGKAPNLLIYAASNLQTG<br>VPSRFSGRGSGTDFTLTISSLQPEDIATYYCQQYDGLPLTFGQGTRLEIKRTVA<br>APSVFIFPPSDEQLKSGTASVVCLLNNFYPREAKVQWKVDNALQSGNSQESV<br>TEQDSKDSTYSLSSTLTLSKADYEKHKVYACEVTHQGLSSPVTKSFNRGECPI<br>KTDVITMDPKDNCSKDANDTLLLQLTNTSAYYMYLLLLLKSVVYFAIITCCL<br>LRRTAFCCNGEKSGSGATNFSLLKQAGDVEENPGPMETDTLLLWVLLLWVP<br>GSTGDIQLTQSPSSLSTSVGDRVTITCQASHDIRNYLNWYQQKPGKAPNLLIY<br>AASNLQTGVPSRFSGRGSGTDFTLTISSLQPEDIATYYCQQYDGLPLTFGQGT<br>RLEIKRSRGGGGSGGGGSGGGGSLEMAQVQLVESGGGLVQPGGSLRLSCAA<br>SGFTFSNYAMSWVRQAPGKGLEWVSSISGSGGSTYYADSVKGRFTISRDTSK<br>NTLYLQMNSLRAEDTAVYYCARYGSAAWMDSWGQGTLVTVSSEQKLISEE<br>DLAAATGPTHLPYVSEMLEARTAGHMQTLADFRQLPARTLSTHWPPQRSLC<br>SSDFIRILVIFSGMFLVFTLAGALFLHQRRKYRSNKGESPVEPAEPCRYSCPRE<br>EEGSTIPIQEDYRKPEPACSP | Construct combination 10 (anti-CD22-scFv-anti-CD22-caTCR + anti-CD22-CSR_5) |
| 11 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSQVQLVESGGGLVQPGGSLRLSCAASGFTFSNYAMSWV<br>RQAPGKGLEWVSSISGSGGSTYYADSVKGRFTISRDTSKNTLYLQMNSLRAE<br>DTAVYYCARYGSAAWMDSWGQGTLVTVSSASTKGPSVFPLAPSSKSTSGGT<br>AALGCLVKDYFPEPVTVSWNSGALTSGVHTFPAVLQSSGLYSLSSVVTVPSS<br>SLGTQTYICNVNHKPSNTKVDKRVEPKSCEVKTDSTDHVKPKETENTKQPSK<br>SCHKPKAIVHTEKVNMMSLTVLGLRMLFAKTVAVNFLLTAKLFFLRAKRSG<br>SGAPVKQTLNFDLLKLAGDVESNPGPMETDTLLLWVLLLWVPGSTGDIQLT<br>QSPSSLSTSVGDRVTITCQASHDIRNYLNWYQQKPGKAPNLLIYAASNLQTG<br>VPSRFSGRGSGTDFTLTISSLQPEDIATYYCQQYDGLPLTFGQGTRLEIKRTVA<br>APSVFIFPPSDEQLKSGTASVVCLLNNFYPREAKVQWKVDNALQSGNSQESV<br>TEQDSKDSTYSLSSTLTLSKADYEKHKVYACEVTHQGLSSPVTKSFNRGECPI<br>KTDVITMDPKDNCSKDANDTLLLQLTNTSAYYMYLLLLLKSVVYFAIITCCL<br>LRRTAFCCNGEKSGSGATNFSLLKQAGDVEENPGPMETDTLLLWVLLLWVP<br>GSTGDIQLTQSPSSLSTSVGDRVTITCQASHDIRNYLNWYQQKPGKAPNLLIY<br>AASNLQTGVPSRFSGRGSGTDFTLTISSLQPEDIATYYCQQYDGLPLTFGQGT<br>RLEIKRSRGGGGSGGGGSGGGGSLEMAQVQLVESGGGLVQPGGSLRLSCAA<br>SGFTFSNYAMSWVRQAPGKGLEWVSSISGSGGSTYYADSVKGRFTISRDTSK<br>NTLYLQMNSLRAEDTAVYYCARYGSAAWMDSWGQGTLVTVSSEQKLISEE<br>DLAAATGTTTPAPRPPTPAPTIASQPLSRPEACRPAAGGAVHTRGLDFACDI<br>YIWAPLAGTCGVLLLSLVITLYCHRRACRKRIRQKLHLCYPVQTSQPKLELV<br>DSRPRRSSTQLRSGASVTEPVAEERGLMSQPLMETCHSVGAAYLESLPLQDA<br>SPAGGPSSPRDLPEPRVSTEHTNNKIEKIYIMKADTVIVGTVKAELPEGRGLA<br>GPAEPELEEELEADHTPHYPEQETEPPLGSCSDVMLSVEEEGKEDPLPTAASG<br>K | Construct combination 11 (anti-CD22-scFv-anti-CD22-caTCR + anti-CD22-CSR_6) |

| SEQ ID NO. | Sequence | Notes |
|---|---|---|
| 12 | METDTLLLWVLLLWVPGSTGDIQLTQSPSSLSTSVGDRVTITCQASHDIRNYL NWYQQKPGKAPNLLIYAASNLQTGVPSRFSGRGSGTDFTLTISSLQPEDIATY YCQQYDGLPLTFGQGTRLEIKRSRGGGGSGGGGSGGGGSLEMAQVQLVESG GGLVQPGGSLRLSCAASGFTFSNYAMSWVRQAPGKGLEWVSSISGSGGSTY YADSVKGRFTISRDTSKNTLYLQMNSLRAEDTAVYYCARYGSAAWMDSWG QGTLVTVSSGGGGSQVQLVESGGGLVQPGGSLRLSCAASGFTFSNYAMSWV RQAPGKGLEWVSSISGSGGSTYYADSVKGRFTISRDTSKNTLYLQMNSLRAE DTAVYYCARYGSAAWMDSWGQGTLVTVSSASTKGPSVFPLAPSSKSTSGGT AALGCLVKDYFPEPVTVSWNSGALTSGVHTFPAVLQSSGLYSLSSVVTVPSS SLGTQTYICNVNHKPSNTKVDKRVEPKSCEVKTDSTDHVKPKETENTKQPSK SCHKPKAIVHTEKVNMMSLTVLGLRMLFAKTVAVNFLLTAKLFFLRAKRSG SGAPVKQTLNFDLLKLAGDVESNPGPMETDTLLLWVLLLWVPGSTGDIQLT QSPSSLSTSVGDRVTITCQASHDIRNYLNWYQQKPGKAPNLLIYAASNLQTG VPSRFSGRGSGTDFTLTISSLQPEDIATYYCQQYDGLPLTFGQGTRLEIKRTVA APSVFIFPPSDEQLKSGTASVVCLLNNFYPREAKVQWKVDNALQSGNSQESV TEQDSKDSTYSLSSTLTLSKADYEKHKVYACEVTHQGLSSPVTKSFNRGECPI KTDVITMDPKDNCSKDANDTLLLQLTNTSAYYMYLLLLLKSVVYFAIITCCL LRRTAFCCNGEKSGSGATNFSLLKQAGDVEENPGPMETDTLLLWVLLLWVP GSTGDIQLTQSPSSLSTSVGDRVTITCQASHDIRNYLNWYQQKPGKAPNLLIY AASNLQTGVPSRFSGRGSGTDFTLTISSLQPEDIATYYCQQYDGLPLTFGQGT RLEIKRSGGGGSGGGGSGGGGSLEMAQVQLVESGGGLVQPGGSLRLSCAA SGFTFSNYAMSWVRQAPGKGLEWVSSISGSGGSTYYADSVKGRFTISRDTSK NTLYLQMNSLRAEDTAVYYCARYGSAAWMDSWGQGTLVTVSSEQKLISEE DLAAATGAPPLGTQPDCNPTPENGEAPASTSPTQSLLVDSQASKTLPIPTSAP VALSSTGKPVLDAGPVLFWVILVLVVVGSSAFLLCHRRACRKRIRQKLHLC YPVQTSQPKLELVDSRPRRSSTQLRSGASVTEPVAEERGLMSQPLMETCHSV GAAYLESLPLQDASPAGGPSSPRDLPEPRVSTEHTNNKIEKIYIMKADTVIVG TVKAELPEGRGLAGPAEPELEEELEADHTPHYPEQETEPPLGSCSDVMLSVE EEGKEDPLPTAASGK | Construct combination 12 (anti-CD22-scFv- anti-CD22-caTCR + anti-CD22-CSR_7) |
| 13 | METDTLLLWVLLLWVPGSTGDIQLTQSPSSLSTSVGDRVTITCQASHDIRNYL NWYQQKPGKAPNLLIYAASNLQTGVPSRFSGRGSGTDFTLTISSLQPEDIATY YCQQYDGLPLTFGQGTRLEIKRSRGGGGSGGGGSGGGGSLEMAQVQLVESG GGLVQPGGSLRLSCAASGFTFSNYAMSWVRQAPGKGLEWVSSISGSGGSTY YADSVKGRFTISRDTSKNTLYLQMNSLRAEDTAVYYCARYGSAAWMDSWG QGTLVTVSSGGGGSQVQLVESGGGLVQPGGSLRLSCAASGFTFSNYAMSWV RQAPGKGLEWVSSISGSGGSTYYADSVKGRFTISRDTSKNTLYLQMNSLRAE DTAVYYCARYGSAAWMDSWGQGTLVTVSSASTKGPSVFPLAPSSKSTSGGT AALGCLVKDYFPEPVTVSWNSGALTSGVHTFPAVLQSSGLYSLSSVVTVPSS SLGTQTYICNVNHKPSNTKVDKRVEPKSCEVKTDSTDHVKPKETENTKQPSK SCHKPKAIVHTEKVNMMSLTVLGLRMLFAKTVAVNFLLTAKLFFLRAKRSG SGAPVKQTLNFDLLKLAGDVESNPGPMETDTLLLWVLLLWVPGSTGDIQLT QSPSSLSTSVGDRVTITCQASHDIRNYLNWYQQKPGKAPNLLIYAASNLQTG VPSRFSGRGSGTDFTLTISSLQPEDIATYYCQQYDGLPLTFGQGTRLEIKRTVA APSVFIFPPSDEQLKSGTASVVCLLNNFYPREAKVQWKVDNALQSGNSQESV TEQDSKDSTYSLSSTLTLSKADYEKHKVYACEVTHQGLSSPVTKSFNRGECPI KTDVITMDPKDNCSKDANDTLLLQLTNTSAYYMYLLLLLKSVVYFAIITCCL LRRTAFCCNGEKSGSGATNFSLLKQAGDVEENPGPMETDTLLLWVLLLWVP GSTGDIQLTQSPSSLSTSVGDRVTITCQASHDIRNYLNWYQQKPGKAPNLLIY AASNLQTGVPSRFSGRGSGTDFTLTISSLQPEDIATYYCQQYDGLPLTFGQGT RLEIKRSGGGGSGGGGSGGGGSLEMAQVQLVESGGGLVQPGGSLRLSCAA SGFTFSNYAMSWVRQAPGKGLEWVSSISGSGGSTYYADSVKGRFTISRDTSK NTLYLQMNSLRAEDTAVYYCARYGSAAWMDSWGQGTLVTVSSEQKLISEE DLAAATGTTTPAPRPPTPAPTIASQPLSLRPEACRPAAGGAVHTRGLDFACDI YIWAPLAGTCGVLLLSLVITLYCALYLLRRDQRLPPDAHKPPGGGSFRTPIQE EQADAHSTLAKI | Construct combination 13 (anti-CD22-scFv- anti-CD22-caTCR + anti-CD22-CSR_8) |
| 14 | METDTLLLWVLLLWVPGSTGDIQLTQSPSSLSTSVGDRVTITCQASHDIRNYL NWYQQKPGKAPNLLIYAASNLQTGVPSRFSGRGSGTDFTLTISSLQPEDIATY YCQQYDGLPLTFGQGTRLEIKRSRGGGGSGGGGSGGGGSLEMAQVQLVESG GGLVQPGGSLRLSCAASGFTFSNYAMSWVRQAPGKGLEWVSSISGSGGSTY YADSVKGRFTISRDTSKNTLYLQMNSLRAEDTAVYYCARYGSAAWMDSWG QGTLVTVSSGGGGSQVQLVESGGGLVQPGGSLRLSCAASGFTFSNYAMSWV RQAPGKGLEWVSSISGSGGSTYYADSVKGRFTISRDTSKNTLYLQMNSLRAE DTAVYYCARYGSAAWMDSWGQGTLVTVSSASTKGPSVFPLAPSSKSTSGGT AALGCLVKDYFPEPVTVSWNSGALTSGVHTFPAVLQSSGLYSLSSVVTVPSS SLGTQTYICNVNHKPSNTKVDKRVEPKSCEVKTDSTDHVKPKETENTKQPSK SCHKPKAIVHTEKVNMMSLTVLGLRMLFAKTVAVNFLLTAKLFFLRAKRSG SGAPVKQTLNFDLLKLAGDVESNPGPMETDTLLLWVLLLWVPGSTGDIQLT QSPSSLSTSVGDRVTITCQASHDIRNYLNWYQQKPGKAPNLLIYAASNLQTG VPSRFSGRGSGTDFTLTISSLQPEDIATYYCQQYDGLPLTFGQGTRLEIKRTVA APSVFIFPPSDEQLKSGTASVVCLLNNFYPREAKVQWKVDNALQSGNSQESV TEQDSKDSTYSLSSTLTLSKADYEKHKVYACEVTHQGLSSPVTKSFNRGECPI KTDVITMDPKDNCSKDANDTLLLQLTNTSAYYMYLLLLLKSVVYFAIITCCL LRRTAFCCNGEKSGSGATNFSLLKQAGDVEENPGPMETDTLLLWVLLLWVP | Construct combination 14 (anti-CD22-scFv- anti-CD22-caTCR + anti-CD22-CSR_9) |

| SEQ ID NO. | Sequence | Notes |
|---|---|---|
| | GSTGDIQLTQSPSSLSTSVGDRVTITCQASHDIRNYLNWYQQKPGKAPNLLIY<br>AASNLQTGVPSRFSGRGSGTDFTLTISSLQPEDIATYYCQQYDGLPLTFGQGT<br>RLEIKRSGGGGSGGGGSGGGGSLEMAQVLVESGGGLVQPGGSLRLSCAA<br>SGFTFSNYAMSWVRQAPGKGLEWVSSISGSGGSTYYADSVKGRFTISRDTSK<br>NTLYLQMNSLRAEDTAVYYCARYGSAAWMDSWGQGTLVTVSSEQKLISEE<br>DLAAATGDRDPPATQPQETQGPPARPITVQPTEAWPRTSQGPSTRPVEVPGG<br>RAVAAILGLGLVLGLLGPLAILLLALYLLRRDQRLPPDAHKPPGGGSFRTPIQE<br>EQADAHSTLAKI | |
| 15 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSGGGGSGGGGSGGGGSLEMAQVLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKSCHKPKAIVHTEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLKSVVYFAIITCCLLRRTAFCCNGEKS | Construct 15<br>(anti-CD22-anti-<br>CD19-caTCR-1)<br>(anti-cd22-scFv +<br>GGGGS + anti-<br>CD19-caTCR) |
| 16 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSGGGGSGGGGSGGGGSLEMAQVLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSGGGGSEVQLVQSGAEVKKPGESLKISCKGSGYSFTSY<br>WIGWVRQMPGKGLEWMGIIYPGDSDTRYSPSFQGQVTISADKSISTAYLQW<br>SSLKASDTAMYYCARQVWGWQGGMYPRSNWWYNLDSWGQGTLVTVSSA<br>STKGPSVFPLAPSSKSTSGGTAALGCLVKDYFPEPVTVSWNSGALTSGVHTF<br>PAVLQSSGLYSLSSVVTVPSSSLGTQTYICNVNHKPSNTKVDKRVEPKSCEV<br>KTDSTDHVKPKETENTKQPSKSCHKPKAIVHTEKVNMMSLTVLGLRMLFAK<br>TVAVNFLLTAKLFFLRAKRSGSGAPVKQTLNFDLLKLAGDVESNPGPMETD<br>TLLLWVLLLWVPGSTGLPVLTQPPSVSVAPGKTARITCGGNNIGSKSVHWY<br>QQKPGQAPVLVVYDDSDRPSGIPERFSGSNSGNTATLTISRVEAGDEADYYC<br>QVWDSSSDYVVFGGGTKLTVLGQPKANPTVTLFPPSSEELQANKATLVCLIS<br>DFYPGAVTVAWKADGSPVKAGVETTKPSKQSNNKYAASSYLSLTPEQWKS<br>HRSYSCQVTHEGSTVEKTVAPTECSPIKTDVITMDPKDNCSKDANDTLLLQL<br>TNTSAYYMYLLLLLKSVVYFAIITCCLLRRTAFCCNGEKS | Construct 16<br>(anti-CD22-anti-<br>CD19-caTCR-2)<br>(anti-CD22-scFv +<br>2xGGGGS + anti-<br>CD19-caTCR) |
| 17 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSGGGGSGGGGSGGGGSLEMAQVLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSTPLGDTTHTSGASTKGPSVFPLAPSSKSTSGGTAALGCLVKDYF<br>PEPVTVSWNSGALTSGVHTFPAVLQSSGLYSLSSVVTVPSSSLGTQTYICNVN<br>HKPSNTKVDKRVEPKSCEVKTDSTDHVKPKETENTKQPSKSCHKPKAIVHTE<br>KVNMMSLTVLGLRMLFAKTVAVNFLLTAKLFFLRAKRSGSGAPVKQTLNF<br>DLLKLAGDVESNPGPMETDTLLLWVLLLWVPGSTGLPVLTQPPSVSVAPGK<br>TARITCGGNNIGSKSVHWYQQKPGQAPVLVVYDDSDRPSGIPERFSGSNSGN<br>TATLTISRVEAGDEADYYCQVWDSSSDYVVFGGGTKLTVLGSRGGGGSGG<br>GGSGGGGSLEMAEVQLVQSGAEVKKPGESLKISCKGSGYSFTSYWIGWVRQ<br>MPGKGLEWMGIIYPGDSDTRYSPSFQGQVTISADKSISTAYLQWSSLKASDT<br>AMYYCARQVWGWQGGMYPRSNWWYNLDSWGQGTLVTVSSTPLGDTTHT<br>SGQPKANPTVTLFPPSSEELQANKATLVCLISDFYPGAVTVAWKADGSPVKA<br>GVETTKPSKQSNNKYAASSYLSLTPEQWKSHRSYSCQVTHEGSTVEKTVAP<br>TECSPIKTDVITMDPKDNCSKDANDTLLLQLTNTSAYYMYLLLLLKSVVYFA<br>IITCCLLRRTAFCCNGEKS | Construct 17<br>(anti-CD22-anti-<br>CD19-caTCR-3)<br>(anti-CD22-scFv +<br>IgCH1 + TCRdelta +<br>anti-CD19-scFv +<br>IgCL +<br>TCRgamma)_upper<br>hinge linker |
| 18 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSGGGGSGGGGSGGGGSLEMAQVLVESG<br>GGLVQPGGSLRLSCAASGFTFSNYAMSWVRQAPGKGLEWVSSISGSGGSTY | Construct 18<br>(anti-CD22-anti-<br>CD19-caTCR-4)<br>(anti-CD22-scFv + |

| SEQ ID NO. | Sequence | Notes |
|---|---|---|
|  | YADSVKGRFTISRDTSKNTLYLQMNSLRAEDTAVYYCARYGSAAWMDSWG<br>QGTLVTVSSGGGGSGGGGSGGGGSASTKGPSVFPLAPSSKSTSGGTAALGCL<br>VKDYFPEPVTVSWNSGALTSGVHTFPAVLQSSGLYSLSSVVTVPSSSLGTQT<br>YICNVNHKPSNTKVDKRVEPKSCEVKTDSTDHVKPKETENTKQPSKSCHKP<br>KAIVHIEKVNMMSLTVLGLRMLFAKTVAVNFLLTAKLFFLRAKRSGSGAPV<br>KQTLNFDLLKLAGDVESNPGPMETDTLLLWVLLLWVPGSTGLPVLTQPPSV<br>SVAPGKTARITCGGNNIGSKSVHWYQQKPGQAPVLVVYDDSDRPSGIPERFS<br>GSNSGNTATLTISRVEAGDEADYYCQVWDSSSDYVVFGGGTKLTVLGSRGG<br>GGSGGGGSGGGGSLEMAEVQLVQSGAEVKKPGESLKISCKGSGYSFTSYWI<br>GWVRQMPGKGLEWMGIIYPGDSDTRYSPSFQGQVTISADKSISTAYLQWSSL<br>KASDTAMYYCARQVWGWQGGMYPRSNWWYNLDSWGQGTLVTVSSGGG<br>GSGGGGSGGGGSQPKANPTVTLFPPSSEELQANKATLVCLISDFYPGAVTVA<br>WKADGSPVKAGVETTKPSKQSNNKYAASSYLSLTPEQWKSHRSYSCQVTHE<br>GSTVEKTVAPTECSPIKTDVITMDPKDNCSKDANDTLLLQLTNTSAYYMYLL<br>LLLKSVVYFAIITCCLLRRTAFCCNGEKS | IgCH1 + TCRdelta + anti-CD19-scFv + IgCL + TCRgamma)_ 3xGGGGS linker |
| 19 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSGGGGSGGGGSASTKGPSVFPLAPSSKSTSGGTAALGCL<br>VKDYFPEPVTVSWNSGALTSGVHTFPAVLQSSGLYELVSVVTVPSSSLGTQT<br>YICNVNHKPSNTKVDKRVEPKSCEVKTDSTDHVKPKETENTKQPSKSCHKP<br>KAIVHIEKVNMMSLTVLGLRMLFAKTVAVNFLLTAKLFFLRAKRSGSGAPV<br>KQTLNFDLLKLAGDVESNPGPMETDTLLLWVLLLWVPGSTGLPVLTQPPSV<br>SVAPGKTARITCGGNNIGSKSVHWYQQKPGQAPVLVVYDDSDRPSGIPERFS<br>GSNSGNTATLTISRVEAGDEADYYCQVWDSSSDYVVFGGGTKLTVLGSRGG<br>GGSGGGGSGGGGSLEMAEVQLVQSGAEVKKPGESLKISCKGSGYSFTSYWI<br>GWVRQMPGKGLEWMGIIYPGDSDTRYSPSFQGQVTISADKSISTAYLQWSSL<br>KASDTAMYYCARQVWGWQGGMYPRSNWWYNLDSWGQGTLVTVSSGGG<br>GSGGGGSGGGGSTVAAPSVFIFPPSDEQLKSGTASVVCLLNNFYPREAKVQW<br>KVDNALQSGNSQESVTEQDSKDSTYSLLSSLTLSKADYEKHKVYACEVTHQ<br>GLSSPVTKSFNRGECPIKTDVITMDPKDNCSKDANDTLLLQLTNTSAYYMYL<br>LLLLKSVVYFAIITCCLLRRTAFCCNGEKS | Construct 19 (anti-CD22-anti-CD19-caTCR-5) (anti-CD22-scFv + IgCH1 (S64E, S66V) + TCRdelta + anti-CD19-scFv + IgCLkappa (S69L, T71S) + TCRgamma)_ 3xGGGGS linker |
| 20 | METDTLLLWVLLLWVPGSTGEVQLVQSGAEVKKPGESLKISCKGSGYSFTS<br>YWIGWVRQMPGKGLEWMGIIYPGDSDTRYSPSFQGQVTISADKSISTAYLQ<br>WSSLKASDTAMYYCARQVWGWQGGMYPRSNWWYNLDSWGQGTLVTVSS<br>GGGGSGGGGSQVQLVESGGGLVQPGGSLRLSCAASGFTFSNYAMSWVRQA<br>PGKGLEWVSSISGSGGSTYYADSVKGRFTISRDTSKNTLYLQMNSLRAEDTA<br>VYYCARYGSAAWMDSWGQGTLVTVSSASTKGPSVFPLAPSSKSTSGGTAAL<br>GCLVKDYFPEPVTVSWNSGALTSGVHTFPAVLQSSGLYSLSSVVTVPSSSLG<br>TQTYICNVNHKPSNTKVDKRVEPKSCEVKTDSTDHVKPKETENTKQPSKSC<br>HKPKAIVHTEKVNMMSLTVLGLRMLFAKTVAVNFLLTAKLFFLRAKRSGSG<br>APVKQTLNFDLLKLAGDVESNPGPMETDTLLLWVLLLWVPGSTGLPVLTQP<br>PSVSVAPGKTARITCGGNNIGSKSVHWYQQKPGQAPVLVVYDDSDRPSGIPE<br>RFSGSNSGNTATLTISRVEAGDEADYYCQVWDSSSDYVVFGGGTKLTVLGG<br>GGGSGGGGSDIQLTQSPSSLSTSVGDRVTITCQASHDIRNYLNWYQQKPGKA<br>PNLLIYAASNLQTGVPSRFSGRGSGTDFTLTISSLQPEDIATYYCQQYDGLPLT<br>FGQGTRLEIKRTVAAPSVFIFPPSDEQLKSGTASVVCLLNNFYPREAKVQWK<br>VDNALQSGNSQESVTEQDSKDSTYSLSSTLTLSKADYEKHKVYACEVTHQG<br>LSSPVTKSFNRGECPIKTDVITMDPKDNCSKDANDTLLLQLTNTSAYYMYLL<br>LLLKSVVYFAIITCCLLRRTAFCCNGEKS | Construct 20 (anti-CD22-anti-CD19-caTCR-6) (anti-CD19 VH + anti-CD22 VH + IgCH1 + TCRdelta + anti-CD19 VL + anti-CD22 VL + IgCLkappa + TCRgamma)_ 2xGGGGS linker |
| 21 | METDTLLLWVLLLWVPGSTGQVQLVESGGGLVQPGGSLRLSCAASGFTFSN<br>YAMSWVRQAPGKGLEWVSSISGSGGSTYYADSVKGRFTISRDTSKNTLYLQ<br>MNSLRAEDTAVYYCARYGSAAWMDSWGQGTLVTVSSGGGGSGGGGSEVQ<br>LVQSGAEVKKPGESLKISCKGSGYSFTSYWIGWVRQMPGKGLEWMGIIYPG<br>DSDTRYSPSFQGQVTISADKSISTAYLQWSSLKASDTAMYYCARQVWGWQ<br>GGMYPRSNWWYNLDSWGQGTLVTVSSASTKGPSVFPLAPSSKSTSGGTAAL<br>GCLVKDYFPEPVTVSWNSGALTSGVHTFPAVLQSSGLYSLSSVVTVPSSSLG<br>TQTYICNVNHKPSNTKVDKRVEPKSCEVKTDSTDHVKPKETENTKQPSKSC<br>HKPKAIVHTEKVNMMSLTVLGLRMLFAKTVAVNFLLTAKLFFLRAKRSGSG<br>APVKQTLNFDLLKLAGDVESNPGPMETDTLLLWVLLLWVPGSTGDIQLTQS<br>PSSLSTSVGDRVTITCQASHDIRNYLNWYQQKPGKAPNLLIYAASNLQTGVP<br>SRFSGRGSGTDFTLTISSLQPEDIATYYCQQYDGLPLTFGQGTRLEIKRGGGG<br>SGGGGSLPVLTQPPSVSVAPGKTARITCGGNNIGSKSVHWYQQKPGQAPVL<br>VVYDDSDRPSGIPERFSGSNSGNTATLTISRVEAGDEADYYCQVWDSSSDYV<br>VFGGGTKLTVLGQPKANPTVTLFPPSSEELQANKATLVCLISDFYPGAVTVA<br>WKADGSPVKAGVETTKPSKQSNNKYAASSYLSLTPEQWKSHRSYSCQVTHE<br>GSTVEKTVAPTECSPIKTDVITMDPKDNCSKDANDTLLLQLTNTSAYYMYLL<br>LLLKSVVYFAIITCCLLRRTAFCCNGEKS | Construct 21 (anti-CD22-anti-CD19-caTCR-7) (anti-CD22 VH + anti-CD19 VH + IgCH1 + TCRdelta + anti-CD22 VL + anti-CD19 VL + IgCL + TCRgamma)_ 2xGGGGS linker |

| SEQ ID NO. | Sequence | Notes |
|---|---|---|
| 22 | METDTLLLWVLLLWVPGSTGEVQLVQSGAEVKKPGESLKISCKGSGYSFTS YWIGWVRQMPGKGLEWMGIIYPGDSDTRYSPSFQGQVTISADKSISTAYLQ WSSLKASDTAMYYCARQVWGWQGGMYPRSNWWYNLDSWGQGTLVTVSS ASTKGPSVFPLAPSSKSTSGGTAALGCLVKDYFPEPVTVSWNSGALTSGVHT FPAVLQSSGLYSLSSVVTVPSSSLGTQTYICNVNHKPSNTKVDKRVEPKSCEV KTDSTDHVKPKETENTKQPSKSCHKPKAIVHTEKVNMMSLTVLGLRMLFAK TVAVNFLLTAKLFFLRAKRSGSGAPVKQTLNFDLLKLAGDVESNPGPMETD TLLLWVLLLWVPGSTGLPVLTQPPSVSVAPGKTARITCGGNNIGSKSVHWY QQKPGQAPVLVVYDDSDRPSGIPERFSGSNSGNTATLTISRVEAGDEADYYC QVWDSSSDYVVFGGGTKLTVLGQPKANPTVTLFPPSSEELQANKATLVCLIS DFYPGAVTVAWKADGSPVKAGVETTKPSKQSNNKYAASSYLSLTPEQWKS HRSYSCQVTHEGSTVEKTVAPTECSPIKTDVITMDPKDNCSKDANDTLLLQL TNTSAYYMYLLLLLKSVVYFAIITCCLLRRTAFCCNGEKS | Construct 22 (anti-CD19-caTCR) |
| 23 | METDTLLLWVLLLWVPGSTGDIQLTQSPSSLSTSVGDRVTITCQASHDIRNYL NWYQQKPGKAPNLLIYAASNLQTGVPSRFSGRGSGTDFTLTISSLQPEDIATY YCQQYDGLPLTFGQGTRLEIKRSRGGGGSGGGGSGGGGSLEMAQVQLVESG GGLVQPGGSLRLSCAASGFTFSNYAMSWVRQAPGKGLEWVSSISGSGGSTY YADSVKGRFTISRDTSKNTLYLQMNSLRAEDTAVYYCARYGSAAWMDSWG QGTLVTVSSGGGGSEVQLVQSGAEVKKPGESLKISCKGSGYSFTSYWIGWV RQMPGKGLEWMGIIYPGDSDTRYSPSFQGQVTISADKSISTAYLQWSSLKAS DTAMYYCARQVWGWQGGMYPRSNWWYNLDSWGQGTLVTVSSASTKGPS VFPLAPSSKSTSGGTAALGCLVKDYFPEPVTVSWNSGALTSGVHTFPAVLQS SGLYSLSSVVTVPSSSLGTQTYICNVNHKPSNTKVDKRVEPKSCEVKTDSTD HVKPKETENTKQPSKSCHKPKAIVHTEKVNMMSLTVLGLRMLFAKTVAVNF LLTAKLFFLRAKRSGSGAPVKQTLNFDLLKLAGDVESNPGPMETDTLLLWV LLLWVPGSTGLPVLTQPPSVSVAPGKTARITCGGNNIGSKSVHWYQQKPGQ APVLVVYDDSDRPSGIPERFSGSNSGNTATLTISRVEAGDEADYYCQVWDSS SDYVVFGGGTKLTVLGQPKANPTVTLFPPSSEELQANKATLVCLISDFYPGA VTVAWKADGSPVKAGVETTKPSKQSNNKYAASSYLSLTPEQWKSHRSYSC QVTHEGSTVEKTVAPTECSPIKTDVITMDPKDNCSKDANDTLLLQLTNTSAY YMYLLLLLKSVVYFAIITCCLLRRTAFCCNGEKSGSGATNFSLLKQAGDVEE NPGPMETDTLLLWVLLLWVPGSTGLPVLTQPPSVSVAPGKTARITCGGNNIG SKSVHWYQQKPGQAPVLVVYDDSDRPSGIPERFSGSNSGNTATLTISRVEAG DEADYYCQVWDSSSDYVVFGGGTKLTVLGSRGGGGSGGGGSGGGGSLEM AEVQLVQSGAEVKKPGESLKISCKGSGYSFTSYWIGWVRQMPGKGLEWMGI IYPGDSDTRYSPSFQGQVTISADKSISTAYLQWSSLKASDTAMYYCARQVWG WQGGMYPRSNWWYNLDSWGQGTLVTVSSEQKLISEEDLAAAIEVMYPPPY LDNEKSNGTIIHVKGKHLCPSPLFPGPSKPFWVLVVVGGVLACYSLLVTVAFI IFWVRSKRSRLLHSDYMNMTPRRPGPTRKHYQPYAPPRDFAAYRS | Construct combination 23 (anti-CD22-anti-CD19-caTCR + anti-CD19-CSR) (construct 15 + anti-CD19 scFv + myc tag + truncated CD28) (anti-CD22-anti-CD19-caTCR-1 + anti-CD19-CSR-1A) (construct 15 + anti-CD19-CSR-1A) (construct 15 + anti-CD19 scFv + truncated CD28) |
| 24 | METDTLLLWVLLLWVPGSTGDIQLTQSPSSLSTSVGDRVTITCQASHDIRNYL NWYQQKPGKAPNLLIYAASNLQTGVPSRFSGRGSGTDFTLTISSLQPEDIATY YCQQYDGLPLTFGQGTRLEIKRSRGGGGSGGGGSGGGGSLEMAQVQLVESG GGLVQPGGSLRLSCAASGFTFSNYAMSWVRQAPGKGLEWVSSISGSGGSTY YADSVKGRFTISRDTSKNTLYLQMNSLRAEDTAVYYCARYGSAAWMDSWG QGTLVTVSSGGGGSLPVLTQPPSVSVAPGKTARITCGGNNIGSKSVHWYQQK PGQAPVLVVYDDSDRPSGIPERFSGSNSGNTATLTISRVEAGDEADYYCQVW DSSSDYVVFGGGTKLTVLGSRGGGGSGGGGSGGGGSLEMAEVQLVQSGAE VKKPGESLKISCKGSGYSFTSYWIGWVRQMPGKGLEWMGITYPGDSDTRYSP SFQGQVTISADKSISTAYLQWSSLKASDTAMYYCARQVWGWQGGMYPRSN WWYNLDSWGQGTLVTVSSGGGGSQVQLQQPGAELVKPGASVKMSCKASG YTFTSYNMHWVKQTPGRGLEWIGAIYPGNGDTSYNQKFKGKATLTADKSSS TAYMQLSSLTSEDSAVYYCARSTYYGGDWYFNVWGAGTTVTVSSASTKGP SVFPLAPSSKSTSGGTAALGCLVKDYFPEPVTVSWNSGALTSGVHTFPAVLQ SSGLYSLSSVVTVPSSSLGTQTYICNVNHKPSNTKVDKRVEPKSCEVKTDSTD HVKPKETENTKQPSKSCHKPKAIVHTEKVNMMSLTVLGLRMLFAKTVAVNF LLTAKLFFLRAKRSGSGAPVKQTLNFDLLKLAGDVESNPGPMETDTLLLWV LLLWVPGSTGQIVLSQSPAILSASPGEKVTMTCRASSSVSYIHWFQQKPGSSP KPWIYATSNLASGVPVRFSGSGSGTSYSLTISRVEAEDAATYYCQQWTSNPP TFGGGTKLEIKRTVAAPSVFIFPPSDEQLKSGTASVVCLLNNFYPREAKVQW KVDNALQSGNSQESVTEQDSKDSTYSLSSTLTLSKADYEKHKVYACEVTHQ GLSSPVTKSFNRGECPIKTDVITMDPKDNCSKDANDTLLLQLTNTSAYYMYL LLLLKSVVYFAIITCCLLRRTAFCCNGEKSDYKDHDGDYKDHDIDYKDDDD K | Construct 24 (anti-CD22-anti-CD19-anti-CD20-caTCR-1) (anti-CD22-scFv + anti-CD19 scFv + anti-CD20 VH + IgCH1 + TCRdelta + anti-CD20 VL + IgCLkappa + TCRgamma + FLAG tag) |
| 25 | METDTLLLWVLLLWVPGSTGDIQLTQSPSSLSTSVGDRVTITCQASHDIRNYL NWYQQKPGKAPNLLIYAASNLQTGVPSRFSGRGSGTDFTLTISSLQPEDIATY YCQQYDGLPLTFGQGTRLEIKRSRGGGGSGGGGSGGGGSLEMAQVQLVESG GGLVQPGGSLRLSCAASGFTFSNYAMSWVRQAPGKGLEWVSSISGSGGSTY YADSVKGRFTISRDTSKNTLYLQMNSLRAEDTAVYYCARYGSAAWMDSWG QGTLVTVSSGGGGSGGGGSQVQLQQPGAELVKPGASVKMSCKASGYTFTS YNMHWVKQTPGRGLEWIGAIYPGNGDTSYNQKFKGKATLTADKSSSTAYM QLSSLTSEDSAVYYCARSTYYGGDWYFNVWGAGTTVTVSSASTKGPSVFPL APSSKSTSGGTAALGCLVKDYFPEPVTVSWNSGALTSGVHTFPAVLQSSGLY | Construct 25 (anti-CD22-anti-CD19-anti-CD20-caTCR-2) (anti-CD22 scFv + anti-CD20 VH + IgCH1 + TCRdelta + anti-CD19 scFv + anti-CD20 VL + |

| SEQ ID NO. | Sequence | Notes |
|---|---|---|
|  | SLSSVVTVPSSSLGTQTYICNVNHKPSNTKVDKRVEPKSCEVKTDSTDHVKP KETENTKQPSKSCHKPKAIVHTEKVNMMSLTVLGLRMLFAKTVAVNFLLTA KLFFLRAKRSGSGAPVKQTLNFDLLKLAGDVESNPGPMETDTLLLWVLLLW VPGSTGLPVLTQPPSVSVAPGKTARITCGGNNIGSKSVHWYQQKPGQAPVLV VYDDSDRPSGIPERFSGSNSGNTATLTISRVEAGDEADYYCQVWDSSSDYVV FGGGTKLTVLGSRGGGGSGGGGSGGGGSLEMAEVQLVQSGAEVKKPGESL KISCKGSGYSFTSYWIGWVRQMPGKGLEWMGITYPGDSDTRYSPSFQGQVTI SADKSISTAYLQWSSLKASDTAMYYCARQVWGWQGGMYPRSNWWYNLD SWGQGTLVTVSSGGGGSGGGGSGGGGSQIVLSQSPAILSASPGEKVTMTCRASSSVS YIHWFQQKPGSSPKPWIYATSNLASGVPVRFSGSGSGTSYSLTISRVEAEDAA TYYCQQWTSNPPTFGGGTKLEIKRTVAAPSVFIFPPSDEQLKSGTASVVCLLN NFYPREAKVQWKVDNALQSGNSQESVTEQDSKDSTYSLSSTLTLSKADYEK HKVYACEVTHQGLSSPVTKSFNRGECPIKTDVITMDPKDNCSKDANDTLLLQ LTNTSAYYMYLLLLLKSVVYFAIITCCLLRRTAFCCNGEKSDYKDHDGDYK DHDIDYKDDDDK | IgCLkappa + TCRgamma + FLAG tag) |
| 26 | METDTLLLWVLLLWVPGSTGDIQLTQSPSSLSTSVGDRVTITCQASHDIRNYL NWYQQKPGKAPNLLIYAASNLQTGVPSRFSGRGSGTDFTLTISSLQPEDIATY YCQQYDGLPLTFGQGTRLEIKRSRGGGGSGGGGSGGGGSLEMAQVQLVESG GGLVQPGGSLRLSCAASGFTFSNYAMSWVRQAPGKGLEWVSSISGSGGSTY YADSVKGRFTISRDTSKNTLYLQMNSLRAEDTAVYYCARYGSAAWMDSWG QGTLVTVSSGGGGSGGGGSGGGGSQVQLQQPGAELVKPGASVKMSCKASG YTFTSYNMHWVKQTPGRGLEWIGAIYPGNGDTSYNQKFKGKATLTADKSSS TAYMQLSSLTSEDSAVYYCARSTYYGGDWYFNVWGAGTTVTVSSASTKGP SVFPLAPSSKSTSGGTAALGCLVKDYFPEPVTVSWNSGALTSGVHTFPAVLQ SSGGLYSLSSVVTVPSSSLGTQTYICNVNHKPSNTKVDKRVEPKSCEVKTDSTD HVKPKETENTKQPSKSCHKPKAIVHTEKVNMMSLTVLGLRMLFAKTVAVNF LLTAKLFFLRAKRSGSGAPVKQTLNFDLLKLAGDVESNPGPMETDTLLLWV LLLWVPGSTGLPVLTQPPSVSVAPGKTARITCGGNNIGSKSVHWYQQKPGQ APVLVVYDDSDRPSGIPERFSGSNSGNTATLTISRVEAGDEADYYCQVWDSS SDYVVFGGGTKLTVLGSRGGGGSGGGGSGGGGSLEMAEVQLVQSGAEVKK PGESLKISCKGSGYSFTSYWIGWVRQMPGKGLEWMGIIYPGDSDTRYSPSFQ GQVTISADKSISTAYLQWSSLKASDTAMYYCARQVWGWQGGMYPRSNWW YNLDSWGQGTLVTVSSGGGGSGGGGSGGGGSQIVLSQSPAILSASPGEKVT MTCRASSSVSYIHWFQQKPGSSPKPWIYATSNLASGVPVRFSGSGSGTSYSLT ISRVEAEDAATYYCQQWTSNPPTFGGGTKLEIKRTVAAPSVFIFPPSDEQLKS GTASVVCLLNNFYPREAKVQWKVDNALQSGNSQESVTEQDSKDSTYSLSST LTLSKADYEKHKVYACEVTHQGLSSPVTKSFNRGECPIKTDVITMDPKDNCS KDANDTLLLQLTNTSAYYMYLLLLLKSVVYFAIITCCLLRRTAFCCNGEKSD YKDHDGDYKDHDIDYKDDDDK | Construct 26 (anti-CD22-anti-CD19-anti-CD20-caTCR-3) (anti-CD22 scFv + anti-CD20 VH + anti-CD19 VH + IgCH1 + TCRdelta + anti-CD19 scFv + anti-CD20 VL + IgCLkappa + TCRgamma + FLAG tag) |
| 27 | METDTLLLWVLLLWVPGSTGDIQLTQSPSSLSTSVGDRVTITCQASHDIRNYL NWYQQKPGKAPNLLIYAASNLQTGVPSRFSGRGSGTDFTLTISSLQPEDIATY YCQQYDGLPLTFGQGTRLEIKRSRGGGGSGGGGSGGGGSLEMAQVQLVESG GGLVQPGGSLRLSCAASGFTFSNYAMSWVRQAPGKGLEWVSSISGSGGSTY YADSVKGRFTISRDTSKNTLYLQMNSLRAEDTAVYYCARYGSAAWMDSWG QGTLVTVSSGGGGSGVQLQQPGAELVKPGASVKMSCKASGYTFTSYNMHW VKQTPGRGLEWIGAIYPGNGDTSYNQKFKGKATLTADKSSSTAYMQLSSLT SEDSAVYYCARSTYYGGDWYFNVWGAGTTVTVSSGGGGSGGGGSEVQLV QSGAEVKKPGESLKISCKGSGYSFTSYWIGWVRQMPGKGLEWMGITYPGDS DTRYSPSFQGQVTISADKSISTAYLQWSSLKASDTAMYYCARQVWGWQGG MYPRSNWWYNLDSWGQGTLVTVSSASTKGPSVFPLAPSSKSTSGGTAALGC LVKDYFPEPVTVSWNSGALTSGVHTFPAVLQSSGGLYSLSSVVTVPSSSLGTQ TYICNVNHKPSNTKVDKRVEPKSCEVKTDSTDHVKPKETENTKQPSKSCHKP KAIVHTEKVNMMSLTVLGLRMLFAKTVAVNFLLTAKLFFLRAKRSGSGAPV KQTLNFDLLKLAGDVESNPGPMETDTLLLWVLLLWVPGSTGQIVLSQSPAIL SASPGEKVTMTCRASSSVSYIHWFQQKPGSSPKPWIYATSNLASGVPVRFSG SGSGTSYSLTISRVEAEDAATYYCQQWTSNPPTFGGGTKLEIKRGGGGSGGG GSLPVLTQPPSVSVAPGKTARITCGGNNIGSKSVHWYQQKPGQAPVLVVYD DSDRPSGIPERFSGSNSGNTATLTISRVEAGDEADYYCQVWDSSSDYVVFGG GTKLTVLGQPKANPTVTLFPPSSEELQANKATLVCLISDFYPGAVTVAWKAD GSPVKAGVETTKPSKQSNNKYAASSYLSLTPEQWKSHRSYSCQVTHEGSTV EKTVAPTECSPIKTDVITMDPKDNCSKDANDTLLLQLTNTSAYYMYLLLLLK SVVYFAIITCCLLRRTAFCCNGEKSDYKDHDGDYKDHDIDYKDDDDK | Construct 27 (anti-CD22-anti-CD19-anti-CD20-caTCR-4) (anti-CD22 scFv + anti-CD20 VH + anti-CD19 VH + IgCH1 + TCRdelta + anti-CD20 VL + anti-CD19 VL + IgCL + TCRgamma + FLAG tag) |
| 28 | METDTLLLWVLLLWVPGSTGQVQLQQPGAELVKPGASVKMSCKASGYTFT SYNMHWVKQTPGRGLEWIGAIYPGNGDTSYNQKFKGKATLTADKSSSTAY MQLSSLTSEDSAVYYCARSTYYGGDWYFNVWGAGTTVTVSSASTKGPSVFP LAPSSKSTSGGTAALGCLVKDYFPEPVTVSWNSGALTSGVHTFPAVLQSSGL YSLSSVVTVPSSSLGTQTYICNVNHKPSNTKVDKRVEPKSCEVKTDSTDHVK PKETENTKQPSKSCHKPKAIVHTEKVNMMSLTVLGLRMLFAKTVAVNFLLT AKLFFLRAKRSGSGAPVKQTLNFDLLKLAGDVESNPGPMETDTLLLWVLLL WVPGSTGQIVLSQSPAILSASPGEKVTMTCRASSSVSYIHWFQQKPGSSPKPW IYATSNLASGVPVRFSGSGSGTSYSLTISRVEAEDAATYYCQQWTSNPPTFGG GTKLEIKRTVAAPSVFIFPPSDEQLKSGTASVVCLLNNFYPREAKVQWKVDN | Construct 28 (anti-CD20-caTCR) (anti-CD20 VH + IgCH1 + TCRdelta + anti-CD20 VL + IgCLkappa + TCRgamma + FLAG tag) |

| SEQ ID NO. | Sequence | Notes |
|---|---|---|
| | ALQSGNSQESVTEQDSKDSTYSLSSTLTLSKADYEKHKVYACEVTHQGLSSP<br>VTKSFNRGECPIKTDVITMDPKDNCSKDANDTLLLQLTNTSAYYMYLLLLLK<br>SVVYFAIITCCLLRRTAFCCNGEKSDYKDHDGDYKDHDIDYKDDDDK | |
| 29 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKSCHKPKAIVHTEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLKSVVYFAIITCCLLRRTAFCCNGEKSGSGATNFSLLKQAGDVEE<br>NPGPMETDTLLLWVLLLWVPGSTGLPVLTQPPSVSVAPGKTARITCGGNNIG<br>SKSVHWYQQKPGQAPVLVVYDDSDRPSGIPERFSGSNSGNTATLTISRVEAG<br>DEADYYCQVWDSSSDYVVFGGGTKLTVLGSRGGGGSGGGGSGGGGSLEM<br>AEVQLVQSGAEVKKPGESLKISCKGSGYSFTSYWIGWVRQMPGKGLEWMGI<br>IYPGDSDTRYSPSFQGQVTISADKSISTAYLQWSSLKASDTAMYYCARQVWG<br>WQGGMYPRSNWWYNLDSWGQGTLVTVSSAAAIEVMYPPPYLDNEKSNGTI<br>IHVKGKHLCPSPLFPGPSKPFWVLVVVGGVLACYSLLVTVAFIIFWVRSKRSR<br>LLHSDYMNMTPRRPGPTRKHYQPYAPPRDFAAYRS | Construct combination 29 (anti-CD22-anti-CD19-caTCR-1 + anti-CD19-CSR-1B) (construct 15 + anti-CD19-CSR-1B) (construct 15 + anti-CD19 scFv + truncated CD28) |
| 30 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKSCHKPKAIVHTEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLKSVVYFAIITCCLLRRTAFCCNGEKSGSGATNFSLLKQAGDVEE<br>NPGPMETDTLLLWVLLLWVPGSTGLPVLTQPPSVSVAPGKTARITCGGNNIG<br>SKSVHWYQQKPGQAPVLVVYDDSDRPSGIPERFSGSNSGNTATLTISRVEAG<br>DEADYYCQVWDSSSDYVVFGGGTKLTVLGSRGGGGSGGGGSGGGGSLEM<br>AEVQLVQSGAEVKKPGESLKISCKGSGYSFTSYWIGWVRQMPGKGLEWMGI<br>IYPGDSDTRYSPSFQGQVTISADKSISTAYLQWSSLKASDTAMYYCARQVWG<br>WQGGMYPRSNWWYNLDSWGQGTLVTVSSEQKLISEEDLAAATGPADLSPG<br>ASSVTPPAPAREPGHSPQIISFFLALTSTALLFLLFFLTLRFSVVKRGRKKLLYI<br>FKQPFMRPVQTTQEEDGCSCRFPEEEEGGCEL | Construct combination 30 (anti-CD22-anti-CD19-caTCR-1 + anti-CD19-CSR-2A) (construct 15 + CD19-CSR-2A) (constmct 15 + CD19 scFc + myc tag + truncated 4-1BB) |
| 31 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKSCHKPKAIVHTEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY | Construct combination 31 (anti-CD22-anti-CD19-caTCR-1 + anti-CD19-CSR-2B) (construct 15 + anti-CD19-CSR-2B) (construct 15 + anti-CD19 scFv + truncated 4-1BB) |

| SEQ ID NO. | Sequence | Notes |
|---|---|---|
| | YMYLLLLLKSVVYFAIITCCLLRRTAFCCNGEKSGSGATNFSLLKQAGDVEE<br>NPGPMETDTLLLWVLLLWVPGSTGLPVLTQPPSVSVAPGKTARITCGGNNIG<br>SKSVHWYQQKPGQAPVLVVYDDSDRPSGIPERFSGSNSGNTATLTISRVEAG<br>DEADYYCQVWDSSDYVVFGGGTKLTVLGSRGGGGSGGGGSGGGGSLEM<br>AEVQLVQSGAEVKKPGESLKISCKGSGYSFTSYWIGWVRQMPGKGLEWMGI<br>IYPGDSDTRYSPSFQGQVTISADKSISTAYLQWSSLKASDTAMYYCARQVWG<br>WQGGMYPRSNWWYNLDSWGQGTLVTVSSAAATGPADLSPGASSVTPPAPA<br>REPGHSPQIISFFLALTSTALLFLLFFLTLRFSVVKRGRKKLLYIFKQPFMRPV<br>QTTQEEDGCSCRFPEEEEGGCEL | |
| 32 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKSCHKPKAIVHtEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPtECSPIKTDVITMDPKDNCSKDANDTLLLQLTNTSAY<br>YMYLLLLLKSVVYFAIITCCLLRRTAFCCNGEKSGSGATNFSLLKQAGDVEE<br>NPGPMETDTLLLWVLLLWVPGSTGLPVLTQPPSVSVAPGKTARITCGGNNIG<br>SKSVHWYQQKPGQAPVLVVYDDSDRPSGIPERFSGSNSGNTATLTISRVEAG<br>DEADYYCQVWDSSDYVVFGGGTKLTVLGSRGGGGSGGGGSGGGGSLEM<br>AEVQLVQSGAEVKKPGESLKISCKGSGYSFTSYWIGWVRQMPGKGLEWMGI<br>IYPGDSDTRYSPSFQGQVTISADKSISTAYLQWSSLKASDTAMYYCARQVWG<br>WQGGMYPRSNWWYNLDSWGQGTLVTVSSEQKLISEEDLAAATGPTHLPYV<br>SEMLEARTAGHMQTLADFRQLPARTLSHWPPQRSLCSSDFIRILVIFSGMFL<br>VFTLAGALFLHQRRKYRSNKGESPVEPAEPCRYSCPREEEGSTIPIQEDYRKP<br>EPACSP | Construct combination 32 (anti-CD22-anti-CD19-caTCR-1 + anti-CD19-CSR-3A) (construct 15 + anti-CD19-CSR-3A) (construct 15 + anti-CD19 scFv + myc tag + truncated CD27) |
| 33 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKSCHKPKAIVHIEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLKSVVYFAIITCCLLRRTAFCCNGEKSGSGATNFSLLKQAGDVEE<br>NPGPMETDTLLLWVLLLWVPGSTGLPVLTQPPSVSVAPGKTARITCGGNNIG<br>SKSVHWYQQKPGQAPVLVVYDDSDRPSGIPERFSGSNSGNTATLTISRVEAG<br>DEADYYCQVWDSSDYVVFGGGTKLTVLGSRGGGGSGGGGSGGGGSLEM<br>AEVQLVQSGAEVKKPGESLKISCKGSGYSFTSYWIGWVRQMPGKGLEWMGI<br>IYPGDSDTRYSPSFQGQVTISADKSISTAYLQWSSLKASDTAMYYCARQVWG<br>WQGGMYPRSNWWYNLDSWGQGTLVTVSSAAATGPTHLPYVSEMLEARTA<br>GHMQTLADFRQLPARTLSHWPPQRSLCSSDFIRILVIFSGMFLVFTLAGALF<br>LHQRRKYRSNKGESPVEPAEPCRYSCPREEEGSTIPIQEDYRKPEPACSP | Construct combination 33 (anti-CD22-anti-CD19-caTCR-1 + anti-CD19-CSR-3B) (construct 15 + anti-CD19-CSR-3B) (construct 15 + anti-CD19 scFv + truncated CD27) |
| 34 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS | Construct combination 34 (anti-CD22-anti-CD19-caTCR-1 + anti-CD19-CSR-4A) (construct 15 + anti-CD19-CSR-4A) |

| SEQ ID NO. | Sequence | Notes |
|---|---|---|
|  | DTAMYYCARQVWGWQGGMYPRSNWWYNLDSWGQGTLVTVSSASTKGPS VFPLAPSSKSTSGGTAALGCLVKDYFPEPVTVSWNSGALTSGVHTFPAVLQS SGLYSLSSVVTVPSSSLGTQTYICNVNHKPSNTKVDKRVEPKSCEVKTDSTD HVKPKETENTKQPSKSCHKPKAIVHIEKVNMMSLTVLGLRMLFAKTVAVNF LLTAKLFFLRAKRSGSGAPVKQTLNFDLLKLAGDVESNPGPMETDTLLLWV LLLWVPGSTGLPVLTQPPSVSVAPGKTARITCGGNNIGSKSVHWYQQKPGQ APVLVVYDDSDRPSGIPERFSGSNSGNTATLTISRVEAGDEADYYCQVWDSS SDYVVFGGGTKLTVLGQPKANPTVTLFPPSSEELQANKATLVCLISDFYPGA VTVAWKADGSPVKAGVETTKPSKQSNNKYAASSYLSLTPEQWKSHRSYSC QVTHEGSTVEKTVAPTECSPIKTDVITMDPKDNCSKDANDTLLLQLTNTSAY YMYLLLLLKSVVYFAIITCCLLRRTAFCCNGEKSGSGATNFSLLKQAGDVEE NPGPMETDTLLLWVLLLWVPGSTGLPVLTQPPSVSVAPGKTARITCGGNNIG SKSVHWYQQKPGQAPVLVVYDDSDRPSGIPERFSGSNSGNTATLTISRVEAG DEADYYCQVWDSSSDYVVFGGGTKLTVLGSRGGGGSGGGGSGGGGSLEM AEVQLVQSGAEVKKPGESLKISCKGSGYSFTSYWIGWVRQMPGKGLEWMGI IYPGDSDTRYSPSFQGQVTISADKSISTAYLQWSSLKASDTAMYYCARQVWG WQGGMYPRSNWWYNLDSWGQGTLVTVSSEQKLISEEDLAAATGAPPLGTQ PDCNPTPENGEAPASTSPTQSLLVDSQASKTLPIPTSAPVALSSTGKPVLDAGP VLFWVILVLVVVGSSAFLLCHRRACRKRIRQKLHLCYPVQTSQPKLELVDS RPRRSSTQLRSGASVTEPVAEERGLMSQPLMETCHSVGAAYLESLPLQDASP AGGPSSPRDLPEPRVSTEHTNNKIEKIYIMKADTVIVGTVKAELPEGRGLAGP AEPELEEELEADHTPHYPEQETEPPLGSCSDVMLSVEEEGKEDPLPTAASGK | (construct 15 + anti-CD19 scFv + myc tag + truncated CD30) |
| 35 | METDTLLLWVLLLWVPGSTGDIQLTQSPSSLSTSVGDRVTITCQASHDIRNYL NWYQQKPGKAPNLLIYAASNLQTGVPSRFSGRGSGTDFTLTISSLQPEDIATY YCQQYDGLPLTFGQGTRLEIKRSRGGGGSGGGGSGGGGSLEMAQVQLVESG GGLVQPGGSLRLSCAASGFTFSNYAMSWVRQAPGKGLEWVSSISGSGGSTY YADSVKGRFTISRDTSKNTLYLQMNSLRAEDTAVYYCARYGSAAWMDSWG QGTLVTVSSGGGGSEVQLVQSGAEVKKPGESLKISCKGSGYSFTSYWIGWV RQMPGKGLEWMGIIYPGDSDTRYSPSFQGQVTISADKSISTAYLQWSSLKAS DTAMYYCARQVWGWQGGMYPRSNWWYNLDSWGQGTLVTVSSASTKGPS VFPLAPSSKSTSGGTAALGCLVKDYFPEPVTVSWNSGALTSGVHTFPAVLQS SGLYSLSSVVTVPSSSLGTQTYICNVNHKPSNTKVDKRVEPKSCEVKTDSTD HVKPKETENTKQPSKSCHKPKAIVHIEKVNMMSLTVLGLRMLFAKTVAVNF LLTAKLFFLRAKRSGSGAPVKQTLNFDLLKLAGDVESNPGPMETDTLLLWV LLLWVPGSTGLPVLTQPPSVSVAPGKTARITCGGNNIGSKSVHWYQQKPGQ APVLVVYDDSDRPSGIPERFSGSNSGNTATLTISRVEAGDEADYYCQVWDSS SDYVVFGGGTKLTVLGQPKANPTVTLFPPSSEELQANKATLVCLISDFYPGA VTVAWKADGSPVKAGVETTKPSKQSNNKYAASSYLSLTPEQWKSHRSYSC QVTHEGSTVEKTVAPTECSPIKTDVITMDPKDNCSKDANDTLLLQLTNTSAY YMYLLLLLKSVVYFAIITCCLLRRTAFCCNGEKSGSGATNFSLLKQAGDVEE NPGPMETDTLLLWVLLLWVPGSTGLPVLTQPPSVSVAPGKTARITCGGNNIG SKSVHWYQQKPGQAPVLVVYDDSDRPSGIPERFSGSNSGNTATLTISRVEAG DEADYYCQVWDSSSDYVVFGGGTKLTVLGSRGGGGSGGGGSGGGGSLEM AEVQLVQSGAEVKKPGESLKISCKGSGYSFTSYWIGWVRQMPGKGLEWMGI IYPGDSDTRYSPSFQGQVTISADKSISTAYLQWSSLKASDTAMYYCARQVWG WQGGMYPRSNWWYNLDSWGQGTLVTVSSAAATGAPPLGTQPDCNPTPEN GEAPASTSPTQSLLVDSQASKTLPIPTSAPVALSSTGKPVLDAGPVLFWVILV LVVVVGSSAFLLCHRRACRKRIRQKLHLCYPVQTSQPKLELVDSRPRRSSTQ LRSGASVTEPVAEERGLMSQPLMETCHSVGAAYLESLPLQDASPAGGPSSPR DLPEPRVSTEHTNNKIEKIYIMKADTVIVGTVKAELPEGRGLAGPAEPELEEE LEADHTPHYPEQETEPPLGSCSDVMLSVEEEGKEDPLPTAASGK | Construct combination 35 (anti-CD22-anti-CD19-caTCR-1 + anti-CD19-CSR-4B) (construct 15 + anti-CD19-CSR-4B) (construct 15 + anti-CD19 scFv + truncated CD30) |
| 36 | METDTLLLWVLLLWVPGSTGDIQLTQSPSSLSTSVGDRVTITCQASHDIRNYL NWYQQKPGKAPNLLIYAASNLQTGVPSRFSGRGSGTDFTLTISSLQPEDIATY YCQQYDGLPLTFGQGTRLEIKRSRGGGGSGGGGSGGGGSLEMAQVQLVESG GGLVQPGGSLRLSCAASGFTFSNYAMSWVRQAPGKGLEWVSSISGSGGSTY YADSVKGRFTISRDTSKNTLYLQMNSLRAEDTAVYYCARYGSAAWMDSWG QGTLVTVSSGGGGSEVQLVQSGAEVKKPGESLKISCKGSGYSFTSYWIGWV RQMPGKGLEWMGIIYPGDSDTRYSPSFQGQVTISADKSISTAYLQWSSLKAS DTAMYYCARQVWGWQGGMYPRSNWWYNLDSWGQGTLVTVSSASTKGPS VFPLAPSSKSTSGGTAALGCLVKDYFPEPVTVSWNSGALTSGVHTFPAVLQS SGLYSLSSVVTVPSSSLGTQTYICNVNHKPSNTKVDKRVEPKSCEVKTDSTD HVKPKETENTKQPSKSCHKPKAIVHIEKVNMMSLTVLGLRMLFAKTVAVNF LLTAKLFFLRAKRSGSGAPVKQTLNFDLLKLAGDVESNPGPMETDTLLLWV LLLWVPGSTGLPVLTQPPSVSVAPGKTARITCGGNNIGSKSVHWYQQKPGQ APVLVVYDDSDRPSGIPERFSGSNSGNTATLTISRVEAGDEADYYCQVWDSS SDYVVFGGGTKLTVLGQPKANPTVTLFPPSSEELQANKATLVCLISDFYPGA VTVAWKADGSPVKAGVETTKPSKQSNNKYAASSYLSLTPEQWKSHRSYSC QVTHEGSTVEKTVAPTECSPIKTDVITMDPKDNCSKDANDTLLLQLTNTSAY YMYLLLLLKSVVYFAIITCCLLRRTAFCCNGEKSGSGATNFSLLKQAGDVEE NPGPMETDTLLLWVLLLWVPGSTGLPVLTQPPSVSVAPGKTARITCGGNNIG SKSVHWYQQKPGQAPVLVVYDDSDRPSGIPERFSGSNSGNTATLTISRVEAG DEADYYCQVWDSSSDYVVFGGGTKLTVLGSRGGGGSGGGGSGGGGSLEM AEVQLVQSGAEVKKPGESLKISCKGSGYSFTSYWIGWVRQMPGKGLEWMGI | Construct combination 36 (anti-CD22-anti-CD19-caTCR-1 + anti-CD19-CSR-5A) (construct 15 + anti-CD19-CSR-5A) (construct 15 + anti-CD19 scFv + myc tag + truncated OX40) |

| SEQ ID NO. | Sequence | Notes |
|---|---|---|
| | IYPGDSDTRYSPSFQGQVTISADKSISTAYLQWSSLKASDTAMYYCARQVWG<br>WQGGMYPRSNWWYNLDSWGQGTLVTVSSEQKLISEEDLAAATGDRDPPAT<br>QPQETQGPPARPITVQPTEAWPRTSQGPSTRPVEVPGGRAVAAILGLGLVLG<br>LLGPLAILLALYLLRRDQRLPPDAHKPPGGSFRTPIQEEQADAHSTLAKI | |
| 37 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKSCHKPKAIVHIEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLKSVVYFAIITCCLLRRTAFCCNGEKSGSGATNFSLLKQAGDVEE<br>NPGPMETDTLLLWVLLLWVPGSTGLPVLTQPPSVSVAPGKTARITCGGNNIG<br>SKSVHWYQQKPGQAPVLVVYDDSDRPSGIPERFSGSNSGNTATLTISRVEAG<br>DEADYYCQVWDSSSDYVVFGGGTKLTVLGSRGGGGSGGGGSGGGGSLEM<br>AEVQLVQSGAEVKKPGESLKISCKGSGYSFTSYWIGWVRQMPGKGLEWMGI<br>IYPGDSDTRYSPSFQGQVTISADKSISTAYLQWSSLKASDTAMYYCARQVWG<br>WQGGMYPRSNWWYNLDSWGQGTLVTVSSAAATGDRDPPATQPQETQGPP<br>ARPITVQPTEAWPRTSQGPSTRPVEVPGGRAVAAILGLGLVLGLLGPLAILLA<br>LYLLRRDQRLPPDAHKPPGGSFRTPIQEEQADAHSTLAKI | Construct combination 37 (anti-CD22-anti-CD19-caTCR-1 + anti-CD19-CSR-5B) (construct 15 + anti-CD19-CSR-5B) (construct 15 + anti-CD19 scFv + truncated OX40) |
| 38 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKSCHKPKAIVHIEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLKSVVYFAIITCCLLRRTAFCCNGEKSGSGATNFSLLKQAGDVEE<br>NPGPMETDTLLLWVLLLWVPGSTGLPVLTQPPSVSVAPGKTARITCGGNNIG<br>SKSVHWYQQKPGQAPVLVVYDDSDRPSGIPERFSGSNSGNTATLTISRVEAG<br>DEADYYCQVWDSSSDYVVFGGGTKLTVLGSRGGGGSGGGGSGGGGSLEM<br>AEVQLVQSGAEVKKPGESLKISCKGSGYSFTSYWIGWVRQMPGKGLEWMGI<br>IYPGDSDTRYSPSFQGQVTISADKSISTAYLQWSSLKASDTAMYYCARQVWG<br>WQGGMYPRSNWWYNLDSWGQGTLVTVSSEQKLISEEDLAAATGTTTPAPR<br>PPTPAPTIASQPLSLRPEACRPAAGGAVHTRGLDFACDIYIWAPLAGTCGVLL<br>LSLVITLYCQRRKYRSNKGESPVEPAEPCRYSCPREEEGSTIPIQEDYRKPEPA<br>CSP | Construct combination 38 (anti-CD22-anti-CD19-caTCR-1 + anti-CD19-CSR-6A) (construct 15 + anti-CD19-CSR-6A) (construct 15 + anti-CD19 scFv + myc tag + CD8 TM and CD27 IC) |
| 39 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKSCHKPKAIVHIEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA | Construct combination 39 (anti-CD22-anti-CD19-caTCR-1 + anti-CD19-CSR-6B) (construct 15 + anti-CD19-CSR-6B) (construct 15 + anti-CD19 scFv + CD8 TM and CD27 IC) |

| SEQ ID NO. | Sequence | Notes |
|---|---|---|
| | VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLKSVVYFAIITCCLLRRTAFCCNGEKSGSGATNFSLLKQAGDVEE<br>NPGPMETDTLLLWVLLLWVPGSTGLPVLTQPPSVSVAPGKTARITCGGNNIG<br>SKSVHWYQQKPGQAPVLVVYDDSDRPSGIPERFSGSNSGNTATLTISRVEAG<br>DEADYYCQVWDSSSDYVVFGGGTKLTVLGSRGGGGSGGGGSGGGGSLEM<br>AEVQLVQSGAEVKKPGESLKISCKGSGYSFTSYWIGWVRQMPGKGLEWMGI<br>IYPGDSDTRYSPSFQGQVTISADKSISTAYLQWSSLKASDTAMYYCARQVWG<br>WQGGMYPRSNWWYNLDSWGQGTLVTVSSAAATGTTTPAPRPPTPAPTIAS<br>QPLSLRPEACRPAAGGAVHTRGLDFACDIYIWAPLAGTCGVLLLSLVITLYC<br>QRRKYRSNKGESPVEPAEPCRYSCPREEEGSTIPIQEDYRKPEPACSP | |
| 40 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKSCHKPKAIVHIEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLKSVVYFAIITCCLLRRTAFCCNGEKSGSGATNFSLLKQAGDVEE<br>NPGPMETDTLLLWVLLLWVPGSTGLPVLTQPPSVSVAPGKTARITCGGNNIG<br>SKSVHWYQQKPGQAPVLVVYDDSDRPSGIPERFSGSNSGNTATLTISRVEAG<br>DEADYYCQVWDSSSDYVVFGGGTKLTVLGSRGGGGSGGGGSGGGGSLEM<br>AEVQLVQSGAEVKKPGESLKISCKGSGYSFTSYWIGWVRQMPGKGLEWMGI<br>IYPGDSDTRYSPSFQGQVTISADKSISTAYLQWSSLKASDTAMYYCARQVWG<br>WQGGMYPRSNWWYNLDSWGQGTLVTVSSSEQKLISEEDLAAATGTTTPAPR<br>PPTPAPTIASQPLSLRPEACRPAAGGAVHTRGLDFACDIYIWAPLAGTCGVLL<br>LSLVITLYCHRRACRKRIRQKLHLCYPVQTSQPKLELVDSRPRRSSTQLRSGA<br>SVTEPVAEERGLMSQPLMETCHSVGAAYLESLPLQDASPAGGPSSPRDLPEP<br>RVSTEHTNNKIEKIYIMKADTVIVGTVKAELPEGRGLAGPAEPELEEELEADH<br>TPHYPEQETEPPLGSCSDVMLSVEEEGKEDPLPTAASGK | Construct combination 40 (anti-CD22-anti-CD19-caTCR-1 + anti-CD19-CSR-7A) (construct 15 + anti-CD19-CSR-7A) (construct 15 + anti-CD19 scFv + myc tag + CD8 TM and CD30 IC) |
| 41 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKSCHKPKAIVHTEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLKSVVYFAIITCCLLRRTAFCCNGEKSGSGATNFSLLKQAGDVEE<br>NPGPMETDTLLLWVLLLWVPGSTGLPVLTQPPSVSVAPGKTARITCGGNNIG<br>SKSVHWYQQKPGQAPVLVVYDDSDRPSGIPERFSGSNSGNTATLTISRVEAG<br>DEADYYCQVWDSSSDYVVFGGGTKLTVLGSRGGGGSGGGGSGGGGSLEM<br>AEVQLVQSGAEVKKPGESLKISCKGSGYSFTSYWIGWVRQMPGKGLEWMGI<br>IYPGDSDTRYSPSFQGQVTISADKSISTAYLQWSSLKASDTAMYYCARQVWG<br>WQGGMYPRSNWWYNLDSWGQGTLVTVSSAAATGTTTPAPRPPTPAPTIAS<br>QPLSLRPEACRPAAGGAVHTRGLDFACDIYIWAPLAGTCGVLLLSLVITLYC<br>HRRACRKRIRQKLHLCYPVQTSQPKLELVDSRPRRSSTQLRSGASVTEPVAE<br>ERGLMSQPLMETCHSVGAAYLESLPLQDASPAGGPSSPRDLPEPRVSTEHTN<br>NKIEKIYIMKADTVIVGTVKAELPEGRGLAGPAEPELEEELEADHTPHYPEQE<br>TEPPLGSCSDVMLSVEEEGKEDPLPTAASGK | Construct combination 41 (anti-CD22-anti-CD19-caTCR-1 + anti-CD19-CSR-7B) (construct 15 + anti-CD19-CSR-7B) (construct 15 + anti-CD19 scFv + CD8 TM and CD30 IC) |
| 42 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG | Construct combination 42 (anti-CD22-anti- |

| SEQ ID NO. | Sequence | Notes |
|---|---|---|
| | GGLVQPGGSLRLSCAASGFTFSNYAMSWVRQAPGKGLEWVSSISGSGGSTY YADSVKGRFTISRDTSKNTLYLQMNSLRAEDTAVYYCARYGSAAWMDSWG QGTLVTVSSGGGGSEVQLVQSGAEVKKPGESLKISCKGSGYSFTSYWIGWV RQMPGKGLEWMGIIYPGDSDTRYSPSFQGQVTISADKSISTAYLQWSSLKAS DTAMYYCARQVWGWQGGMYPRSNWWYNLDSWGQGTLVTVSSASTKGPS VFPLAPSSKSTSGGTAALGCLVKDYFPEPVTVSWNSGALTSGVHTFPAVLQS SGLYSLSSVVTVPSSSLGTQTYICNVNHKPSNTKVDKRVEPKSCEVKTDSTD HVKPKETENTKQPSKCHKPKAIVHTEKVNMMSLTVLGLRMLFAKTVAVNF LLTAKLFFLRAKRSGSGAPVKQTLNFDLLKLAGDVESNPGPMETDTLLLWV LLLWVPGSTGLPVLTQPPSVSVAPGKTARITCGGNNIGSKSVHWYQQKPGQ APVLVVYDDSDRPSGIPERFSGSNSGNTATLTISRVEAGDEADYYCQVWDSS SDYVVFGGGTKLTVLGQPKANPTVTLFPPSSEELQANKATLVCLISDFYPGA VTVAWKADGSPVKAGVETTKPSKQSNNKYAASSYLSLTPEQWKSHRSYSC QVTHEGSTVEKTVAPTECSPIKTDVITMDPKDNCSKDANDTLLLQLTNTSAY YMYLLLLLLKSVVYFAIITCCLLRRTAFCCNGEKSGSGATNFSLLKQAGDVEE NPGPMETDTLLLWVLLLWVPGSTGLPVLTQPPSVSVAPGKTARITCGGNNIG SKSVHWYQQKPGQAPVLVVYDDSDRPSGIPERFSGSNSGNTATLTISRVEAG DEADYYCQVWDSSSDYVVFGGGTKLTVLGSRGGGGSGGGGSGGGGSLEM AEVQLVQSGAEVKKPGESLKISCKGSGYSFTSYWIGWVRQMPGKGLEWMGI IYPGDSDTRYSPSFQGQVTISADKSISTAYLQWSSLKASDTAMYYCARQVWG WQGGMYPRSNWWYNLDSWGQGTLVTVSSEQKLISEEDLAAATGTTTPAPR PPTPAPTIASQPLSLRPEACRPAAGGAVHTRGLDFACDIYIWAPLAGTCGVLL LSLVITLYCALYLLRRDQRLPPDAHKPPGGSFRTPIQEEQADAHSTLAKI | CD19-caTCR-1 + anti-CD19-CSR-8A) (construct 15 + anti-CD19-CSR-8A) (construct 15 + anti-CD19 scFv + myc tag + CD8 TM and OX40 IC) |
| 43 | METDTLLLWVLLLWVPGSTGDIQLTQSPSSLSTSVGDRVTITCQASHDIRNYL NWYQQKPGKAPNLLIYAASNLQTGVPSRFSGRGSGTDFTLTISSLQPEDIATY YCQQYDGLPLTFGQGTRLEIKRSRGGGGSGGGGSGGGGSLEMAQVQLVESG GGLVQPGGSLRLSCAASGFTFSNYAMSWVRQAPGKGLEWVSSISGSGGSTY YADSVKGRFTISRDTSKNTLYLQMNSLRAEDTAVYYCARYGSAAWMDSWG QGTLVTVSSGGGGSEVQLVQSGAEVKKPGESLKISCKGSGYSFTSYWIGWV RQMPGKGLEWMGIIYPGDSDTRYSPSFQGQVTISADKSISTAYLQWSSLKAS DTAMYYCARQVWGWQGGMYPRSNWWYNLDSWGQGTLVTVSSASTKGPS VFPLAPSSKSTSGGTAALGCLVKDYFPEPVTVSWNSGALTSGVHTFPAVLQS SGLYSLSSVVTVPSSSLGTQTYICNVNHKPSNTKVDKRVEPKSCEVKTDSTD HVKPKETENTKQPSKCHKPKAIVHTEKVNMMSLTVLGLRMLFAKTVAVNF LLTAKLFFLRAKRSGSGAPVKQTLNFDLLKLAGDVESNPGPMETDTLLLWV LLLWVPGSTGLPVLTQPPSVSVAPGKTARITCGGNNIGSKSVHWYQQKPGQ APVLVVYDDSDRPSGIPERFSGSNSGNTATLTISRVEAGDEADYYCQVWDSS SDYVVFGGGTKLTVLGQPKANPTVTLFPPSSEELQANKATLVCLISDFYPGA VTVAWKADGSPVKAGVETTKPSKQSNNKYAASSYLSLTPEQWKSHRSYSC QVTHEGSTVEKTVAPTECSPIKTDVITMDPKDNCSKDANDTLLLQLTNTSAY YMYLLLLLLKSVVYFAIITCCLLRRTAFCCNGEKSGSGATNFSLLKQAGDVEE NPGPMETDTLLLWVLLLWVPGSTGLPVLTQPPSVSVAPGKTARITCGGNNIG SKSVHWYQQKPGQAPVLVVYDDSDRPSGIPERFSGSNSGNTATLTISRVEAG DEADYYCQVWDSSSDYVVFGGGTKLTVLGSRGGGGSGGGGSGGGGSLEM AEVQLVQSGAEVKKPGESLKISCKGSGYSFTSYWIGWVRQMPGKGLEWMGI IYPGDSDTRYSPSFQGQVTISADKSISTAYLQWSSLKASDTAMYYCARQVWG WQGGMYPRSNWWYNLDSWGQGTLVTVSSAAATGTTTPAPRPPTPAPTIAS QPLSLRPEACRPAAGGAVHTRGLDFACDIYIWAPLAGTCGVLLLSLVITLYC ALYLLRRDQRLPPDAHKPPGGSFRTPIQEEQADAHSTLAKI | Construct combination 43 (anti-CD22-anti-CD19-caTCR-1 + anti-CD19-CSR-8B) (construct 15 + anti-CD19-CSR-8B) (construct 15 + anti-CD19 scFv + CD8 TM and OX40 IC) |
| 44 | METDTLLLWVLLLWVPGSTGDIQLTQSPSSLSTSVGDRVTITCQASHDIRNYL NWYQQKPGKAPNLLIYAASNLQTGVPSRFSGRGSGTDFTLTISSLQPEDIATY YCQQYDGLPLTFGQGTRLEIKRSRGGGGSGGGGSGGGGSLEMAQVQLVESG GGLVQPGGSLRLSCAASGFTFSNYAMSWVRQAPGKGLEWVSSISGSGGSTY YADSVKGRFTISRDTSKNTLYLQMNSLRAEDTAVYYCARYGSAAWMDSWG QGTLVTVSSGGGGSEVQLVQSGAEVKKPGESLKISCKGSGYSFTSYWIGWV RQMPGKGLEWMGIIYPGDSDTRYSPSFQGQVTISADKSISTAYLQWSSLKAS DTAMYYCARQVWGWQGGMYPRSNWWYNLDSWGQGTLVTVSSASTKGPS VFPLAPSSKSTSGGTAALGCLVKDYFPEPVTVSWNSGALTSGVHTFPAVLQS SGLYSLSSVVTVPSSSLGTQTYICNVNHKPSNTKVDKRVEPKSCEVKTDSTD HVKPKETENTKQPSKCHKPKAIVHTEKVNMMSLTVLGLRMLFAKTVAVNF LLTAKLFFLRAKRSGSGAPVKQTLNFDLLKLAGDVESNPGPMETDTLLLWV LLLWVPGSTGLPVLTQPPSVSVAPGKTARITCGGNNIGSKSVHWYQQKPGQ APVLVVYDDSDRPSGIPERFSGSNSGNTATLTISRVEAGDEADYYCQVWDSS SDYVVFGGGTKLTVLGQPKANPTVTLFPPSSEELQANKATLVCLISDFYPGA VTVAWKADGSPVKAGVETTKPSKQSNNKYAASSYLSLTPEQWKSHRSYSC QVTHEGSTVEKTVAPTECSPIKTDVITMDPKDNCSKDANDTLLLQLTNTSAY YMYLLLLLLKSVVYFAIITCCLLRRTAFCCNGEKSGSGATNFSLLKQAGDVEE NPGPMETDTLLLWVLLLWVPGSTGDIQLTQSPSSLSTSVGDRVTITCQASHDI RNYLNWYQQKPGKAPNLLIYAASNLQTGVPSRFSGRGSGTDFTLTISSLQPE DIATYYCQQYDGLPLTFGQGTRLEIKRSRGGGGSGGGGSGGGGSLEMAQVQ LVESGGGLVQPGGSLRLSCAASGFTFSNYAMSWVRQAPGKGLEWVSSISGS GGSTYYADSVKGRFTISRDTSKNTLYLQMNSLRAEDTAVYYCARYGSAAW MDSWGQGTLVTVSSVTVSSEQKLISEEDLAAAIEVMYPPPYLDNEKSNGTIIH | Construct combination 44 (anti-CD22-anti-CD19-caTCR-1 + anti-CD22-CSR-1A) (construct 15 + anti-CD22-CSR-1A) (construct 15 + anti-CD22 scFv + myc tag + truncated CD28) |

| SEQ ID NO. | Sequence | Notes |
|---|---|---|
| | VKGKHLCPSPLFPGPSKPFWVLVVVGGVLACYSLLVTVAFIIFWVRSKRSRL LHSDYMNMTPRRPGPTRKHYQPYAPPRDFAAYRS | |
| 45 | METDTLLLWVLLLWVPGSTGDIQLTQSPSSLSTSVGDRVTITCQASHDIRNYL NWYQQKPGKAPNLLIYAASNLQTGVPSRFSGRGSGTDFTLTISSLQPEDIATY YCQQYDGLPLTFGQGTRLEIKRSRGGGGSGGGGSGGGGSLEMAQVQLVESG GGLVQPGGSLRLSCAASGFTFSNYAMSWVRQAPGKGLEWVSSISGSGGSTY YADSVKGRFTISRDTSKNTLYLQMNSLRAEDTAVYYCARYGSAAWMDSWG QGTLVTVSSGGGGSEVQLVQSGAEVKKPGESLKISCKGSGYSFTSYWIGWV RQMPGKGLEWMGIIYPGDSDTRYSPSFQGQVTISADKSISTAYLQWSSLKAS DTAMYYCARQVWGWQGGMYPRSNWWYNLDSWGQGTLVTVSSASTKGPS VFPLAPSSKSTSGGTAALGCLVKDYFPEPVTVSWNSGALTSGVHTFPAVLQS SGLYSLSSVVTVPSSSLGTQTYICNVNHKPSNTKVDKRVEPKSCEVKTDSTD HVKPKEIENTKQPSKCHKPKAIVHIEKVNMMSLTVLGLRMLFAKTVAVNF LLTAKLFFLRAKRSGSGAPVKQTLNFDLLKLAGDVESNPGPMETDTLLLWV LLLWVPGSTGLPVLTQPPSVSVAPGKTARITCGGNNIGSKSVHWYQQKPGQ APVLVVYDDSDRPSGIPERFSGSNSGNTATLTISRVEAGDEADYYCQVWDSS SDYVVFGGGTKLTVLGQPKANPTVTLFPPSSEELQANKATLVCLISDFYPGA VTVAWKADGSPVKAGVETTKPSKQSNNKYAASSYLSLTPEQWKSHRSYSC QVTHEGSTVEKTVAPTECSPIKTDVITMDPKDNCSKDANDTLLLQLTNTSAY YMYLLLLLKSVVYFAIITCCLLRRTAFCCNGEKSGSGATNFSLLKQAGDVEE NPGPMETDTLLLWVLLLWVPGSTGDIQLTQSPSSLSTSVGDRVTITCQASHDI RNYLNWYQQKPGKAPNLLIYAASNLQTGVPSRFSGRGSGTDFTLTISSLQPE DIATYYCQQYDGLPLTFGQGTRLEIKRSRGGGGSGGGGSGGGGSLEMAQVQ LVESGGGLVQPGGSLRLSCAASGFTFSNYAMSWVRQAPGKGLEWVSSISGS GGSTYYADSVKGRFTISRDTSKNTLYLQMNSLRAEDTAVYYCARYGSAAW MDSWGQGTLVTVSSVTVSSAAAIEVMYPPPYLDNEKSNGTIIHVKGKHLCPS PLFPGPSKPFWVLVVVGGVLACYSLLVTVAFIIFWVRSKRSRLLHSDYMNMT PRRPGPTRKHYQPYAPPRDFAAYRS | Construct combination 45 (anti-CD22-anti-CD19-caTCR-1 + anti-CD22-CSR-1B) (construct 15 + anti-CD22-CSR-1B) (construct 15 + anti-CD22 scFv + truncated CD28) |
| 46 | METDTLLLWVLLLWVPGSTGDIQLTQSPSSLSTSVGDRVTITCQASHDIRNYL NWYQQKPGKAPNLLIYAASNLQTGVPSRFSGRGSGTDFTLTISSLQPEDIATY YCQQYDGLPLTFGQGTRLEIKRSRGGGGSGGGGSGGGGSLEMAQVQLVESG GGLVQPGGSLRLSCAASGFTFSNYAMSWVRQAPGKGLEWVSSISGSGGSTY YADSVKGRFTISRDTSKNTLYLQMNSLRAEDTAVYYCARYGSAAWMDSWG QGTLVTVSSGGGGSEVQLVQSGAEVKKPGESLKISCKGSGYSFTSYWIGWV RQMPGKGLEWMGIIYPGDSDTRYSPSFQGQVTISADKSISTAYLQWSSLKAS DTAMYYCARQVWGWQGGMYPRSNWWYNLDSWGQGTLVTVSSASTKGPS VFPLAPSSKSTSGGTAALGCLVKDYFPEPVTVSWNSGALTSGVHTFPAVLQS SGLYSLSSVVTVPSSSLGTQTYICNVNHKPSNTKVDKRVEPKSCEVKTDSTD HVKPKEIENTKQPSCHKPKAIVHIEKVNMMSLTVLGLRMLFAKTVAVNF LLTAKLFFLRAKRSGSGAPVKQTLNFDLLKLAGDVESNPGPMETDTLLLWV LLLWVPGSTGLPVLTQPPSVSVAPGKTARITCGGNNIGSKSVHWYQQKPGQ APVLVVYDDSDRPSGIPERFSGSNSGNTATLTISRVEAGDEADYYCQVWDSS SDYVVFGGGTKLTVLGQPKANPTVTLFPPSSEELQANKATLVCLISDFYPGA VTVAWKADGSPVKAGVETTKPSKQSNNKYAASSYLSLTPEQWKSHRSYSC QVTHEGSTVEKTVAPTECSPIKTDVITMDPKDNCSKDANDTLLLQLTNTSAY YMYLLLLLKSVVYFAIITCCLLRRTAFCCNGEKSGSGATNFSLLKQAGDVEE NPGPMETDTLLLWVLLLWVPGSTGDIQLTQSPSSLSTSVGDRVTITCQASHDI RNYLNWYQQKPGKAPNLLIYAASNLQTGVPSRFSGRGSGTDFTLTISSLQPE DIATYYCQQYDGLPLTFGQGTRLEIKRSRGGGGSGGGGSGGGGSLEMAQVQ LVESGGGLVQPGGSLRLSCAASGFTFSNYAMSWVRQAPGKGLEWVSSISGS GGSTYYADSVKGRFTISRDTSKNTLYLQMNSLRAEDTAVYYCARYGSAAW MDSWGQGTLVTVSSVTVSSEQKLISEEDLAAATGPADLSPGASSVTPPAPAR EPGHSPQIISFFLALTSTALLFLLFFLTLRFSVVKRGRKKLLYIFKQPFMRPVQT TQEEDGCSCRFPEEEEGGCEL | Construct combination 46 (anti-CD22-anti-CD19-caTCR-1 + anti-CD22-CSR-2A) (construct 15 + anti-CD22-CSR-2A) (construct 15 + anti-CD22 scFv + myc tag + truncated 4-1BB) |
| 47 | METDTLLLWVLLLWVPGSTGDIQLTQSPSSLSTSVGDRVTITCQASHDIRNYL NWYQQKPGKAPNLLIYAASNLQTGVPSRFSGRGSGTDFTLTISSLQPEDIATY YCQQYDGLPLTFGQGTRLEIKRSRGGGGSGGGGSGGGGSLEMAQVQLVESG GGLVQPGGSLRLSCAASGFTFSNYAMSWVRQAPGKGLEWVSSISGSGGSTY YADSVKGRFTISRDTSKNTLYLQMNSLRAEDTAVYYCARYGSAAWMDSWG QGTLVTVSSGGGGSEVQLVQSGAEVKKPGESLKISCKGSGYSFTSYWIGWV RQMPGKGLEWMGIIYPGDSDTRYSPSFQGQVTISADKSISTAYLQWSSLKAS DTAMYYCARQVWGWQGGMYPRSNWWYNLDSWGQGTLVTVSSASTKGPS VFPLAPSSKSTSGGTAALGCLVKDYFPEPVTVSWNSGALTSGVHTFPAVLQS SGLYSLSSVVTVPSSSLGTQTYICNVNHKPSNTKVDKRVEPKSCEVKTDSTD HVKPKETENTKQPSKCHKPKAIVHTEKVNMMSLTVLGLRMLFAKTVAVNF LLTAKLFFLRAKRSGSGAPVKQTLNFDLLKLAGDVESNPGPMETDTLLLWV LLLWVPGSTGLPVLTQPPSVSVAPGKTARITCGGNNIGSKSVHWYQQKPGQ APVLVVYDDSDRPSGIPERFSGSNSGNTATLTISRVEAGDEADYYCQVWDSS SDYVVFGGGTKLTVLGQPKANPTVTLFPPSSEELQANKATLVCLISDFYPGA VTVAWKADGSPVKAGVETTKPSKQSNNKYAASSYLSLTPEQWKSHRSYSC QVTHEGSTVEKTVAPTECSPIKTDVITMDPKDNCSKDANDTLLLQLTNTSAY YMYLLLLLKSVVYFAIITCCLLRRTAFCCNGEKSGSGATNFSLLKQAGDVEE | Construct combination 47 (anti-CD22-anti-CD19-caTCR-1 + anti-CD22-CSR-2B) (construct 15 + anti-CD22-CSR-2B) (construct 15 + anti-CD22 scFv + truncated 4-1BB) |

| SEQ ID NO. | Sequence | Notes |
|---|---|---|
| | NPGPMETDTLLLWVLLLWVPGSTGDIQLTQSPSSLSTSVGDRVTITCQASHDI<br>RNYLNWYQQKPGKAPNLLIYAASNLQTGVPSRFSGRGSGTDFTLTISSLQPE<br>DIATYYCQQYDGLPLTFGQGTRLEIKRSRGGGSGGGGSGGGGSLEMAQVQ<br>LVESGGGLVQPGGSLRLSCAASGFTFSNYAMSWVRQAPGKGLEWVSSISGS<br>GGSTYYADSVKGRFTISRDTSKNTLYLQMNSLRAEDTAVYYCARYGSAAW<br>MDSWGQGTLVTVSSVTVSSAAATGPADLSPGASSVTPPAPAREPGHSPQIISF<br>FLALTSTALLFLLFFLTLRFSVVKRGRKKLLYIFKQPFMRPVQTTQEEDGCSC<br>RFPEEEEGGCEL | |
| 48 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKSCHKPKAIVHTEKVNMMSLTVLGLRMLFAKTVAVNF<br>LLTAKLFFLRAKSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLKSVVYFAIITCCLLRRTAFCCNGEKSGSGATNFSLLKQAGDVEE<br>NPGPMETDTLLLWVLLLWVPGSTGDIQLTQSPSSLSTSVGDRVTITCQASHDI<br>RNYLNWYQQKPGKAPNLLIYAASNLQTGVPSRFSGRGSGTDFTLTISSLQPE<br>DIATYYCQQYDGLPLTFGQGTRLEIKRSRGGGSGGGGSGGGGSLEMAQVQ<br>LVESGGGLVQPGGSLRLSCAASGFTFSNYAMSWVRQAPGKGLEWVSSISGS<br>GGSTYYADSVKGRFTISRDTSKNTLYLQMNSLRAEDTAVYYCARYGSAAW<br>MDSWGQGTLVTVSSVTVSSEQKLISEEDLAAATGPTHLPYVSEMLEARTAG<br>HMQTLADFRQLPARTLSTHWPPQRSLCSSDFIRILVIFSGMFLVFTLAGALFL<br>HQRRKYRSNKGESPVEPAEPCRYSCPREEEGSTIPIQEDYRKPEPACSP | Construct combination 48 (anti-CD22-anti-CD19-caTCR-1 + anti-CD22-CSR-3A) (construct 15 + anti-CD22-CSR-3A) (construct 15 + anti-CD22 scFv + myc tag + truncated CD27) |
| 49 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKSCHKPKAIVHIEKVNMMSLTVLGLRMLFAKTVAVNF<br>LLTAKLFFLRAKSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLKSVVYFAIITCCLLRRTAFCCNGEKSGSGATNFSLLKQAGDVEE<br>NPGPMETDTLLLWVLLLWVPGSTGDIQLTQSPSSLSTSVGDRVTITCQASHDI<br>RNYLNWYQQKPGKAPNLLIYAASNLQTGVPSRFSGRGSGTDFTLTISSLQPE<br>DIATYYCQQYDGLPLTFGQGTRLEIKRSRGGGSGGGGSGGGGSLEMAQVQ<br>LVESGGGLVQPGGSLRLSCAASGFTFSNYAMSWVRQAPGKGLEWVSSISGS<br>GGSTYYADSVKGRFTISRDTSKNTLYLQMNSLRAEDTAVYYCARYGSAAW<br>MDSWGQGTLVTVSSVTVSSAAATGPTHLPYVSEMLEARTAGHMQTLADFR<br>QLPARTLSTHWPPQRSLCSSDFIRILVIFSGMFLVFTLAGALFLHQRRKYRSN<br>KGESPVEPAEPCRYSCPREEEGSTIPIQEDYRKPEPACSP | Construct combination 49 (anti-CD22-anti-CD19-caTCR-1 + anti-CD22-CSR-3B) (construct 15 + anti-CD22-CSR-3B) (construct 15 + anti-CD22 scFv + truncated CD27) |
| 50 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKSCHKPKAIVHIEKVNMMSLTVLGLRMLFAKTVAVNF<br>LLTAKLFFLRAKSGSGAPVKQTLNFDLLKLAGDVESNPGPMETDTLLLWV | Construct combination 50 (anti-CD22-anti-CD19-caTCR-1 + anti-CD22-CSR-4A) (construct 15 + anti-CD22-CSR-4A) (construct 15 + anti-CD22 scFv + myc tag + truncated CD30) |

| SEQ ID NO. | Sequence | Notes |
|---|---|---|
| | LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLKSVVYFAIITCCLLRRTAFCCNGEKSGSGATNFSLLKQAGDVEE<br>NPGPMETDTLLLWVLLLWVPGSTGDIQLTQSPSSLSTSVGDRVTITCQASHDI<br>RNYLNWYQQKPGKAPNLLIYAASNLQTGVPSRFSGRGSGTDFTLTISSLQPE<br>DIATYYCQQYDGLPLTFGQGTRLEIKRSRGGGGSGGGGSGGGGSLEMAQVQ<br>LVESGGGLVQPGGSLRLSCAASGFTFSNYAMSWVRQAPGKGLEWVSSISGS<br>GGSTYYADSVKGRFTISRDTSKNTLYLQMNSLRAEDTAVYYCARYGSAAW<br>MDSWGQGTLVTVSSVTVSSEQKLISEEDLAAATGAPPLGTQPDCNPTPENGE<br>APASTSPTQSLLVDSQASKTLPIPTSAPVALSSTGKPVLDAGPVLFWVILVLV<br>VVVGSSAFLLCHRRACRKRIRQKLHLCYPVQTSQPKLELVDSRPRRSSTQLR<br>SGASVTEPVAEERGLMSQPLMETCHSVGAAYLESLPLQDASPAGGPSSPRDL<br>PEPRVSTEHTNNKIEKIYIMKADTVIVGTVKAELPEGRGLAGPAEPELEEELE<br>ADHTPHYPEQETEPPLGSCSDVMLSVEEEGKEDPLPTAASGK | |
| 51 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKSCHKPKAIVHIEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLKSVVYFAIITCCLLRRTAFCCNGEKSGSGATNFSLLKQAGDVEE<br>NPGPMETDTLLLWVLLLWVPGSTGDIQLTQSPSSLSTSVGDRVTITCQASHDI<br>RNYLNWYQQKPGKAPNLLIYAASNLQTGVPSRFSGRGSGTDFTLTISSLQPE<br>DIATYYCQQYDGLPLTFGQGTRLEIKRSRGGGGSGGGGSGGGGSLEMAQVQ<br>LVESGGGLVQPGGSLRLSCAASGFTFSNYAMSWVRQAPGKGLEWVSSISGS<br>GGSTYYADSVKGRFTISRDTSKNTLYLQMNSLRAEDTAVYYCARYGSAAW<br>MDSWGQGTLVTVSSVTVSSAAATGAPPLGTQPDCNPTPENGEAPASTSPTQS<br>LLVDSQASKTLPIPTSAPVALSSTGKPVLDAGPVLFWVILVLVVVVGSSAFLL<br>CHRRACRKRIRQKLHLCYPVQTSQPKLELVDSRPRRSSTQLRSGASVTEPVA<br>EERGLMSQPLMETCHSVGAAYLESLPLQDASPAGGPSSPRDLPEPRVSTEHT<br>NNKIEKIYIMKADTVIVGTVKAELPEGRGLAGPAEPELEEELEADHTPHYPEQ<br>ETEPPLGSCSDVMLSVEEEGKEDPLPTAASGK | Construct combination 51 (anti-CD22-anti-CD19-caTCR-1 + anti-CD22-CSR-4B) (construct 15 + anti-CD22-CSR-4B) (construct 15 + anti-CD22 scFv + truncated CD30) |
| 52 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKSCHKPKAIVHIEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLKSVVYFAIITCCLLRRTAFCCNGEKSGSGATNFSLLKQAGDVEE<br>NPGPMETDTLLLWVLLLWVPGSTGDIQLTQSPSSLSTSVGDRVTITCQASHDI<br>RNYLNWYQQKPGKAPNLLIYAASNLQTGVPSRFSGRGSGTDFTLTISSLQPE<br>DIATYYCQQYDGLPLTFGQGTRLEIKRSRGGGGSGGGGSGGGGSLEMAQVQ<br>LVESGGGLVQPGGSLRLSCAASGFTFSNYAMSWVRQAPGKGLEWVSSISGS<br>GGSTYYADSVKGRFTISRDTSKNTLYLQMNSLRAEDTAVYYCARYGSAAW<br>MDSWGQGTLVTVSSVTVSSEQKLISEEDLAAATGDRDPPATQPQETGPPAR<br>PITVQPTEAWPRTSQGPSTRPVEVPGGRAVAAILGLGLVLGLLGPLAILLALY<br>LLRRDQRLPPDAHKPPGGGSFRTPIQEEQADAHSTLAKI | Construct combination 52 (anti-CD22-anti-CD19-caTCR-1 + anti-CD229-CSR-5A) (construct 15 + anti-CD229-CSR-5A) (construct 15 + anti-CD22 scFv + myc tag + truncated OX40) |

| SEQ ID NO. | Sequence | Notes |
|---|---|---|
| 53 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKCHKPKAIVHTEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLKSVVYFAIITCCLLRRTAFCCNGEKSGSGATNFSLLKQAGDVEE<br>NPGPMETDTLLLWVLLLWVPGSTGDIQLTQSPSSLSTSVGDRVTITCQASHDI<br>RNYLNWYQQKPGKAPNLLIYAASNLQTGVPSRFSGRGSGTDFTLTISSLQPE<br>DIATYYCQQYDGLPLTFGQGTRLEIKRSRGGGGSGGGGSGGGGSLEMAQVQ<br>LVESGGGLVQPGGSLRLSCAASGFTFSNYAMSWVRQAPGKGLEWVSSISGS<br>GGSTYYADSVKGRFTISRDTSKNTLYLQMNSLRAEDTAVYYCARYGSAAW<br>MDSWGQGTLVTVSSVTVSSAAATGDRDPPATQPQETQGPPARPITVQPILA<br>WPRTSQGPSTRPVEVPGGRAVAAILGLGLVLGLLGPLAILLALYLLRRDQRL<br>PPDAHKPPGGGSFRTPIQEEQADAHSTLAKI | Construct combination 53 (anti-CD22-anti-CD19-caTCR-1 + anti-CD22-CSR-5B) (construct 15 + anti-CD22-CSR-5B) (construct 15 + anti-CD22 scFv + truncated OX40) |
| 54 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKCHKPKAIVHTEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLKSVVYFAIITCCLLRRTAFCCNGEKSGSGATNFSLLKQAGDVEE<br>NPGPMETDTLLLWVLLLWVPGSTGDIQLTQSPSSLSTSVGDRVTITCQASHDI<br>RNYLNWYQQKPGKAPNLLIYAASNLQTGVPSRFSGRGSGTDFTLTISSLQPE<br>DIATYYCQQYDGLPLTFGQGTRLEIKRSRGGGGSGGGGSGGGGSLEMAQVQ<br>LVESGGGLVQPGGSLRLSCAASGFTFSNYAMSWVRQAPGKGLEWVSSISGS<br>GGSTYYADSVKGRFTISRDTSKNTLYLQMNSLRAEDTAVYYCARYGSAAW<br>MDSWGQGTLVTVSSVTVSSEQKLISEEDLAAATGTTTPAPRPPTPAPTIASQP<br>LSLRPEACRPAAGGAVHTRGLDFACDIYIWAPLAGTCGVLLLSLVITLYCQR<br>RKYRSNKGESPVEPAEPCRYSCPREEEGSTIPIQEDYRKPEPACSP | Construct combination 54 (anti-CD22-anti-CD19-caTCR-1 + anti-CD22-CSR-6A) (construct 15 + anti-CD22-CSR-6A) (construct 15 + anti-CD22 scFv + myc tag + CD8 TM and CD27 IC) |
| 55 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKCHKPKAIVHTEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLKSVVYFAIITCCLLRRTAFCCNGEKSGSGATNFSLLKQAGDVEE<br>NPGPMETDTLLLWVLLLWVPGSTGDIQLTQSPSSLSTSVGDRVTITCQASHDI<br>RNYLNWYQQKPGKAPNLLIYAASNLQTGVPSRFSGRGSGTDFTLTISSLQPE<br>DIATYYCQQYDGLPLTFGQGTRLEIKRSRGGGGSGGGGSGGGGSLEMAQVQ | Construct combination 55 (anti-CD22-anti-CD19-caTCR-1 + anti-CD22-CSR-6B) (construct 15 + anti-CD22-CSR-6B) (construct 15 + anti-CD22 scFv + CD8 TM and CD27 IC) |

| SEQ ID NO. | Sequence | Notes |
|---|---|---|
| | LVESGGGLVQPGGSLRLSCAASGFTFSNYAMSWVRQAPGKGLEWVSSISGS<br>GGSTYYADSVKGRFTISRDTSKNTLYLQMNSLRAEDTAVYYCARYGSAAW<br>MDSWGQGTLVTVSSVTVSSAAATGTTTPAPRPPTPAPTIASQPLSLRPEACRP<br>AAGGAVHTRGLDFACDIYIWAPLAGTCGVLLLSLVITLYCQRRKYRSNKGES<br>PVEPAEPCRYSCPREEEGSTIPIQEDYRKPEPACSP | |
| 56 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKCHKPKAIVHTEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLKSVVYFAIITCCLLRRTAFCCNGEKSGSGATNFSLLKQAGDVEE<br>NPGPMETDTLLLWVLLLWVPGSTGDIQLTQSPSSLSTSVGDRVTITCQASHDI<br>RNYLNWYQQKPGKAPNLLIYAASNLQTGVPSRFSGRGSGTDFTLTISSLQPE<br>DIATYYCQQYDGLPLTFGQGTRLEIKRSRGGGGSGGGGSGGGGSLEMAQVQ<br>LVESGGGLVQPGGSLRLSCAASGFTFSNYAMSWVRQAPGKGLEWVSSISGS<br>GGSTYYADSVKGRFTISRDTSKNTLYLQMNSLRAEDTAVYYCARYGSAAW<br>MDSWGQGTLVTVSSVTVSSEQKLISEEDLAAATGTTTPAPRPPTPAPTIASQP<br>LSLRPEACRPAAGGAVHTRGLDFACDIYIWAPLAGTCGVLLLSLVITLYCHR<br>RACRKRIRQKLHLCYPVQTSQPKLELVDSRPRRSSTQLRSGASVTEPVAEER<br>GLMSQPLMETCHSVGAAYLESLPLQDASPAGGPSSPRDLPEPRVSTEHTNNK<br>IEKIYIMKADTVIVGTVKAELPEGRGLAGPAEPELEEELEADHTPHYPEQETE<br>PPLGSCSDVMLSVEEEGKEDPLPTAASGK | Construct combination 56 (anti-CD22-anti-CD19-caTCR-1 + anti-CD22-CSR-7A) (construct 15 + anti-CD22-CSR-7A) (construct 15 + anti-CD22 scFv + myc tag + CD8 TM and CD30 IC) |
| 57 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKCHKPKAIVHTEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLKSVVYFAIITCCLLRRTAFCCNGEKSGSGATNFSLLKQAGDVEE<br>NPGPMETDTLLLWVLLLWVPGSTGDIQLTQSPSSLSTSVGDRVTITCQASHDI<br>RNYLNWYQQKPGKAPNLLIYAASNLQTGVPSRFSGRGSGTDFTLTISSLQPE<br>DIATYYCQQYDGLPLTFGQGTRLEIKRSRGGGGSGGGGSGGGGSLEMAQVQ<br>LVESGGGLVQPGGSLRLSCAASGFTFSNYAMSWVRQAPGKGLEWVSSISGS<br>GGSTYYADSVKGRFTISRDTSKNTLYLQMNSLRAEDTAVYYCARYGSAAW<br>MDSWGQGTLVTVSSVTVSSAAATGTTTPAPRPPTPAPTIASQPLSLRPEACRP<br>AAGGAVHTRGLDFACDIYIWAPLAGTCGVLLLSLVITLYCHRRACRKRIRQK<br>LHLCYPVQTSQPKLELVDSRPRRSSTQLRSGASVTEPVAEERGLMSQPLMET<br>CHSVGAAYLESLPLQDASPAGGPSSPRDLPEPRVSTEHTNNKIEKIYIMKADT<br>VIVGTVKAELPEGRGLAGPAEPELEEELEADHTPHYPEQETEPPLGSCSDVM<br>LSVEEEGKEDPLPTAASGK | Construct combination 57 (anti-CD22-anti-CD19-caTCR-1 + anti-CD22-CSR-7B) (construct 15 + anti-CD22-CSR-7B) (construct 15 + anti-CD22 scFv + CD8 TM and CD30 IC) |
| 58 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS | Construct combination 58 CD19-caTCR-1 (anti-CD22-anti-anti-CD22-CSR-8A) (construct 15 + anti-CD22-CSR-8A) (construct 15 + anti-CD22 scFv + myc |

| SEQ ID NO. | Sequence | Notes |
|---|---|---|
| | SGLYSLSSVVTVPSSSLGTQTYICNVNHKPSNTKVDKRVEPKSCEVKTDSTD<br>HVKPKETENTKQPSKSCHKPKAIVHTEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLLKSVVYFAIITCCLLRRTAFCCNGEKSGSGATNFSLLKQAGDVEE<br>NPGPMETDTLLLWVLLLWVPGSTGDIQLTQSPSSLSTSVGDRVTITCQASHDI<br>RNYLNWYQQKPGKAPNLLIYAASNLQTGVPSRFSGRGSGTDFTLTISSLQPE<br>DIATYYCQQYDGLPLTFGQGTRLEIKRSGGGGSGGGGSGGGGSLEMAQVQ<br>LVESGGGLVQPGGSLRLSCAASGFTFSNYAMSWVRQAPGKGLEWVSSISIGS<br>GGSTYYADSVKGRFTISRDTSKNTLYLQMNSLRAEDTAVYYCARYGSAAW<br>MDSWGQGTLVTVSSVTVSSEQKLISEEDLAAATGTTTPAPRPPTPAPTIASQP<br>LSLRPEACRPAAGGAVHTRGLDFACDIYIWAPLAGTCGVLLLSLVITLYCAL<br>YLLRRDQRLPPDAHKPPGGGSFRTPIQEEQADAHSTLAKI | tag + CD8 TM and<br>OX40 IC) |
| 59 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKSCHKPKAIVHTEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLLKSVVYFAIITCCLLRRTAFCCNGEKSGSGATNFSLLKQAGDVEE<br>NPGPMETDTLLLWVLLLWVPGSTGDIQLTQSPSSLSTSVGDRVTITCQASHDI<br>RNYLNWYQQKPGKAPNLLIYAASNLQTGVPSRFSGRGSGTDFTLTISSLQPE<br>DIATYYCQQYDGLPLTFGQGTRLEIKRSGGGGSGGGGSGGGGSLEMAQVQ<br>LVESGGGLVQPGGSLRLSCAASGFTFSNYAMSWVRQAPGKGLEWVSSISGS<br>GGSTYYADSVKGRFTISRDTSKNTLYLQMNSLRAEDTAVYYCARYGSAAW<br>MDSWGQGTLVTVSSVTVSSAAATGTTTPAPRPPTPAPTIASQPLSLRPEACRP<br>AAGGAVHTRGLDFACDIYIWAPLAGTCGVLLLSLVITLYCALYLLRRDQRLP<br>PDAHKPPGGGSFRTPIQEEQADAHSTLAKI | Construct<br>combination 59<br>(anti-CD22-anti-<br>CD19-caTCR-1 +<br>anti-CD22-CSR-8B)<br>(construct 15 + anti-<br>CD22-CSR-8B)<br>(construct 15 + anti-<br>CD22 scFv + CD8<br>TM and OX40 IC) |
| 60 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKSCHKPKAIVHTEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLLKSVVYFAIITCCLLRRTAFCCNGEKSGSGATNFSLLKQAGDVEE<br>NPGPMETDTLLLWVLLLWVPGSTGLPVLTQPPSVSVAPGKTARITCGGNNIG<br>SKSVHWYQQKPGQAPVLVVYDDSDRPSGIPERFSGSNSGNTATLTISRVEAG<br>DEADYYCQVWDSSSDYVVFGGGTKLTVLGSRGGGGSGGGGSGGGGSLEM<br>AEVQLVQSGAEVKKPGESLKISCKGSGYSFTSYWIGWVRQMPGKGLEWMGI<br>IYPGDSDTRYSPSFQGQVTISADKSISTAYLQWSSLKASDTAMYYCARQVWG<br>WQGGMYPRSNWWYNLDSWGQGTLVTVSSGGGGSGGGGSQIVLSQSPAILS<br>ASPGEKVTMTCRASSSVSYIHWFQQKPGSSPKPWIYATSNLASGVPVRFSGS | Construct<br>combination 60<br>(anti-CD22-anti-<br>CD19-caTCR-1 +<br>anti-CD19-anti-<br>CD20-CSR-1A)<br>(construct 15 + anti-<br>CD19-anti-CD20-<br>CSR-1A)<br>(construct 15 + anti-<br>CD19 scFv + anti-<br>CD20 scFv + myc<br>tag + truncated<br>CD28) |

| SEQ ID NO. | Sequence | Notes |
|---|---|---|
| | GSGTSYSLTISRVEAEDAATYYCQQWTSNPPTFGGGTKLEIKRSGGGGSGG<br>GGSGGGGSLEQVQLQQPGAELVKPGASVKMSCKASGYTFTSYNMHWVKQ<br>TPGRGLEWIGAIYPGNGDTSYNQKFKGKATLTADKSSSTAYMQLSSLTSEDS<br>AVYYCARSTYYGGDWYFNVWGAGTTVTVSSEQKLISEEDLAAAIEVMYPPP<br>YLDNEKSNGTIIHVKGKHLCPSPLFPGPSKPFWVLVVVGGVLACYSLLVTVA<br>FIIFWVRSKRSRLLHSDYMNMTPRRPGPTRKHYQPYAPPRDFAAYRS | |
| 61 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKSCHKPKAIVHIEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLLKSVVYFAIITCCLLRRTAFCCNGEKSGSGATNFSLLKQAGDVEE<br>NPGPMETDTLLLWVLLLWVPGSTGLPVLTQPPSVSVAPGKTARITCGGNNIG<br>SKSVHWYQQKPGQAPVLVVYDDSDRPSGIPERFSGSNSGNTATLTISRVEAG<br>DEADYYCQVWDSSSDYVVFGGGTKLTVLGSRGGGGSGGGGSGGGGSLEM<br>AEVQLVQSGAEVKKPGESLKISCKGSGYSFTSYWIGWVRQMPGKGLEWMGI<br>IYPGDSDTRYSPSFQGQVTISADKSISTAYLQWSSLKASDTAMYYCARQVWG<br>WQGGMYPRSNWWYNLDSWGQGTLVTVSSGGGGSGGGGSQIVLSQSPAILS<br>ASPGEKVTMTCRASSSVSYIHWFQQKPGSSPKPWIYATSNLASGVPVRFSGS<br>GSGTSYSLTISRVEAEDAATYYCQQWTSNPPTFGGGTKLEIKRSGGGGSGG<br>GGSGGGGSLEQVQLQQPGAELVKPGASVKMSCKASGYTFTSYNMHWVKQ<br>TPGRGLEWIGAIYPGNGDTSYNQKFKGKATLTADKSSSTAYMQLSSLTSEDS<br>AVYYCARSTYYGGDWYFNVWGAGTTVTVSSAAAIEVMYPPPYLDNEKSNG<br>TIIHVKGKHLCPSPLFPGPSKPFWVLVVVGGVLACYSLLVTVAFBFWVRSKR<br>SRLLHSDYMNMTPRRPGPTRKHYQPYAPPRDFAAYRS | Construct combination 61 (anti-CD22-anti-CD19-caTCR-1 + anti-CD19-anti-CD20-CSR-1B) (construct 15 + anti-CD19-anti-CD20-CSR-1B) (construct 15 + anti-CD19 scFv + anti-CD20 scFv + truncated CD28) |
| 62 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKSCHKPKAIVHIEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLLKSVVYFAIITCCLLRRTAFCCNGEKSGSGATNFSLLKQAGDVEE<br>NPGPMETDTLLLWVLLLWVPGSTGLPVLTQPPSVSVAPGKTARITCGGNNIG<br>SKSVHWYQQKPGQAPVLVVYDDSDRPSGIPERFSGSNSGNTATLTISRVEAG<br>DEADYYCQVWDSSSDYVVFGGGTKLTVLGSRGGGGSGGGGSGGGGSLEM<br>AEVQLVQSGAEVKKPGESLKISCKGSGYSFTSYWIGWVRQMPGKGLEWMGI<br>IYPGDSDTRYSPSFQGQVTISADKSISTAYLQWSSLKASDTAMYYCARQVWG<br>WQGGMYPRSNWWYNLDSWGQGTLVTVSSGGGGSGGGGSQIVLSQSPAILS<br>ASPGEKVTMTCRASSSVSYIHWFQQKPGSSPKPWIYATSNLASGVPVRFSGS<br>GSGTSYSLTISRVEAEDAATYYCQQWTSNPPTFGGGTKLEIKRSGGGGSGG<br>GGSGGGGSLEQVQLQQPGAELVKPGASVKMSCKASGYTFTSYNMHWVKQ<br>TPGRGLEWIGAIYPGNGDTSYNQKFKGKATLTADKSSSTAYMQLSSLTSEDS<br>AVYYCARSTYYGGDWYFNVWGAGTTVTVSSEQKLISEEDLAAATGPADLS<br>PGASSVTPPAPAREPGHSPQIISFFLALTSTALLFLLFFLTLRFSVVKRGRKKLL<br>YIFKQPFMRPVQTTQEEDGCSCRFPEEEEGGCEL | Construct combination 62 (anti-CD22-anti-CD19-caTCR-1 + anti-CD19-anti-CD20-CSR-2A) (construct 15 + anti-CD19-anti-CD20-CSR-2A) (construct 15 + anti-CD19 scFv + anti-CD20 scFv + myc tag + truncated 4-1BB) |
| 63 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSGGGGSGGGGSGGGGSLEMAQVQLVESG<br>GGLVQPGGSLRLSCAASGFTFSNYAMSWVRQAPGKGLEWVSSISGSGGSTY | Construct combination 63 (anti-CD22-anti-CD19-caTCR-1 + |

-continued

| SEQ ID NO. | Sequence | Notes |
|---|---|---|
| | YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKSCHKPKAIVHTEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLKSVVYFAIITCCLLRRTAFCCNGEKSGSGATNFSLLKQAGDVEE<br>NPGPMETDTLLLWVLLLWVPGSTGLPVLTQPPSVSVAPGKTARITCGGNNIG<br>SKSVHWYQQKPGQAPVLVVYDDSDRPSGIPERFSGSNSGNTATLTISRVEAG<br>DEADYYCQVWDSSSDYVVFGGGTKLTVLGSRGGGGSGGGGSGGGGSLEM<br>AEVQLVQSGAEVKKPGESLKISCKGSGYSFTSYWIGWVRQMPGKGLEWMGI<br>IYPGDSDTRYSPSFQGVTISADKSISTAYLQWSSLKASDTAMYYCARQVWG<br>WQGGMYPRSNWWYNLDSWGQGTLVTVSSGGGGSGGGGSQIVLSQSPAILS<br>ASPGEKVTMTCRASSSVSYIHWFQQKPGSSPKPWIYATSNLASGVPVRFSGS<br>GSGTSYSLTISRVEAEDAATYYCQQWTSNPPTFGGGTKLEIKRSRGGGGSGG<br>GGSGGGGSLEQVQLQQPGAELVKPGASVKMSCKASGYTFTSYNMHWVKQ<br>TPGRGLEWIGAIYPGNGDTSYNQKFKGKATLTADKSSSTAYMQLSSLTSEDS<br>AVYYCARSTYYGGDWYFNVWGAGTTVTVSSAAATGPADLSPGASSVTPPA<br>PAREPGHSPQIISFFLALTSTALLFLLFFLTLRFSVVKRGRKKLLYIFKQPFMRP<br>VQTTQEEDGCSCRFPEEEEGGCEL | anti-CD19-anti-<br>CD20-CSR-2B)<br>(construct 15 + anti-<br>CD19-anti-CD20-<br>CSR-2B)<br>(construct 15 + anti-<br>CD19 scFv + anti-<br>CD20 scFv +<br>truncated 4-1BB) |
| 64 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKSCHKPKAIVHTEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLKSVVYFAIITCCLLRRTAFCCNGEKSGSGATNFSLLKQAGDVEE<br>NPGPMETDTLLLWVLLLWVPGSTGLPVLTQPPSVSVAPGKTARITCGGNNIG<br>SKSVHWYQQKPGQAPVLVVYDDSDRPSGIPERFSGSNSGNTATLTISRVEAG<br>DEADYYCQVWDSSSDYVVFGGGTKLTVLGSRGGGGSGGGGSGGGGSLEM<br>AEVQLVQSGAEVKKPGESLKISCKGSGYSFTSYWIGWVRQMPGKGLEWMGI<br>IYPGDSDTRYSPSFQGVTISADKSISTAYLQWSSLKASDTAMYYCARQVWG<br>WQGGMYPRSNWWYNLDSWGQGTLVTVSSGGGGSGGGGSQIVLSQSPAILS<br>ASPGEKVTMTCRASSSVSYIHWFQQKPGSSPKPWIYATSNLASGVPVRFSGS<br>GSGTSYSLTISRVEAEDAATYYCQQWTSNPPTFGGGTKLEIKRSRGGGGSGG<br>GGSGGGGSLEQVQLQQPGAELVKPGASVKMSCKASGYTFTSYNMHWVKQ<br>TPGRGLEWIGAIYPGNGDTSYNQKFKGKATLTADKSSSTAYMQLSSLTSEDS<br>AVYYCARSTYYGGDWYFNVWGAGTTVTVSSEQKLISEEDLAAATGPTHLP<br>YVSEMLEARTAGHMTQLADFRQLPARTLSTHWPPQRSLCSSDFIRILVIFSGM<br>FLVFTLAGALFLHQRRKYRSNKGESPVEPAEPCRYSCPREEEGSTIPIQEDYR<br>KPEPACSP | Construct<br>combination 64<br>(anti-CD22-anti-<br>CD19-caTCR-1 +<br>anti-CD19-anti-<br>CD20-CSR-3A)<br>(construct 15 + anti-<br>CD19-anti-CD20-<br>CSR-3A)<br>(construct 15 + anti-<br>CD19 scFv + anti-<br>CD20 scFv + myc<br>tag + truncated<br>CD27) |
| 65 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKSCHKPKAIVHIEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS | Construct<br>combination 65<br>(anti-CD22-anti-<br>CD19-caTCR-1 +<br>anti-CD19-anti-<br>CD20-CSR-3B)<br>(construct 15 + anti-<br>CD19-anti-CD20-<br>CSR-3B)<br>(construct 15 + anti-<br>CD19 scFv + anti-<br>CD20 scFv +<br>truncated CD27) |

| SEQ ID NO. | Sequence | Notes |
|---|---|---|
| | SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLKSVVYFAIITCCLLRRTAFCCNGEKSGSGATNFSLLKQAGDVEE<br>NPGPMETDTLLLWVLLLWVPGSTGLPVLTQPPSVSVAPGKTARITCGGNNIG<br>SKSVHWYQQKPGQAPVLVVYDDSDRPSGIPERFSGSNSGNTATLTISRVEAG<br>DEADYYCQVWDSSSDYVVFGGGTKLTVLGSRGGGGSGGGGSGGGGSLEM<br>AEVQLVQSGAEVKKPGESLKISCKGSGYSFTSYWIGWVRQMPGKGLEWMGI<br>IYPGDSDTRYSPSFQGQVTISADKSISTAYLQWSSLKASDTAMYYCARQVWG<br>WQGGMYPRSNWWYNLDSWGQGTLVTVSSGGGGSGGGGSGGGGSQIVLSQSPAILS<br>ASPGEKVTMTCRASSSVSYIHWFQQKPGSSPKPWIYATSNLASGVPVRFSGS<br>GSGTSYSLTISRVEAEDAATYYCQQWTSNPPTFGGGTKLEIKRSRGGGGSGG<br>GGSGGGGSLEVQLQQPGAELVKPGASVKMSCKASGYTFTSYNMHWVKQ<br>TPGRGLEWIGAIYPGNGDTSYNQKFKGKATLTADKSSSTAYMQLSSLTSEDS<br>AVYYCARSTYYGGDWYFNVWGAGTTVTVSSAAATGPTHLPYVSEMLEART<br>AGHMQTLADFRQLPARTLSTHWPPQRSLCSSDFIRILVIFSGMFLVFTLAGAL<br>FLHQRRKYRSNKGESPVEPAEPCRYSCPREEEGSTIPIQEDYRKPEPACSP | |
| 66 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSISGSGGSTY<br>YADSVKGRFTISRDNSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKSCHKPKAIVHIEKVNMMSLTVLGLRMLFAKTVAVNF<br>LLTAKLFFLRAKRSGSGAPVKQTLNFDDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLKSVVYFAIITCCLLRRTAFCCNGEKSGSGATNFSLLKQAGDVEE<br>NPGPMETDTLLLWVLLLWVPGSTGLPVLTQPPSVSVAPGKTARITCGGNNIG<br>SKSVHWYQQKPGQAPVLVVYDDSDRPSGIPERFSGSNSGNTATLTISRVEAG<br>DEADYYCQVWDSSSDYVVFGGGTKLTVLGSRGGGGSGGGGSGGGGSLEM<br>AEVQLVQSGAEVKKPGESLKISCKGSGYSFTSYWIGWVRQMPGKGLEWMGI<br>IYPGDSDTRYSPSFQGQVTISADKSISTAYLQWSSLKASDTAMYYCARQVWG<br>WQGGMYPRSNWWYNLDSWGQGTLVTVSSGGGGSGGGGSQIVLSQSPAILS<br>ASPGEKVTMTCRASSSVSYIHWFQQKPGSSPKPWIYATSNLASGVPVRFSGS<br>GSGTSYSLTISRVEAEDAATYYCQQWTSNPPTFGGGTKLEIKRSRGGGGSGG<br>GGSGGGGSLEVQLQQPGAELVKPGASVKMSCKASGYTFTSYNMHWVKQ<br>TPGRGLEWIGAIYPGNGDTSYNQKFKGKATLTADKSSSTAYMQLSSLTSEDS<br>AVYYCARSTYYGGDWYFNVWGAGTTVTVSSEQKLISEEDLAAATGAPPLG<br>TQPPDCNPTPENGEAPASTSPTQSLLVDSQASKTLPIPTSAPVALSSTGKPVLDA<br>GPVLFWVILVLVVVGSSAFLLCHRRACRKRIRQKLHLCYPVQTSQPKLELV<br>DSRPRRSSTQLRSGASVTEPVAEERGLMSQPLMETCHSVGAAYLESLPLQDA<br>SPAGGPSSPRDLPEPRVSTEHTNNKIEKIYIMKADTVIVGTVKAELPEGRGLA<br>GPAEPELEEELEADHTPHYPEQETEPPLGSCSDVMLSVEEEGKEDPLPTAASG<br>K | Construct combination 66 (anti-CD22-anti-CD19-caTCR-1 + anti-CD19-anti-CD20-CSR-4A) (construct 15 + anti-CD19-anti-CD20-CSR-4A) (construct 15 + anti-CD19 scFv + anti-CD20 scFv + myc tag + truncated CD30) |
| 67 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKSCHKPKAIVHTEKVNMMSLTVLGLRMLFAKTVAVNF<br>LLTAKLFFLRAKRSGSGAPVKQTLNFDDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLKSVVYFAIITCCLLRRTAFCCNGEKSGSGATNFSLLKQAGDVEE<br>NPGPMETDTLLLWVLLLWVPGSTGLPVLTQPPSVSVAPGKTARITCGGNNIG<br>SKSVHWYQQKPGQAPVLVVYDDSDRPSGIPERFSGSNSGNTATLTISRVEAG<br>DEADYYCQVWDSSSDYVVFGGGTKLTVLGSRGGGGSGGGGSGGGGSLEM | Construct combination 67 (anti-CD22-anti-CD19-caTCR-1 + anti-CD19-anti-CD20-CSR-4B) (construct 15 + anti-CD19-anti-CD20-CSR-4B) (construct 15 + anti-CD19 scFv + anti-CD20 scFv + truncated CD30) |

| SEQ ID NO. | Sequence | Notes |
|---|---|---|
|  | AEVQLVQSGAEVKKPGESLKISCKGSGYSFTSYWIGWVRQMPGKGLEWMGI<br>IYPGDSDTRYSPSFQGQVTISADKSISTAYLQWSSLKASDTAMYYCARQVWG<br>WQGGMYPRSNWWYNLDSWGQGTLVTVSSGGGGSGGGGSQIVLSQSPAILS<br>ASPGEKVTMTCRASSSVSYIHWFQQKPGSSPKPWIYATSNLASGVPVRFSGS<br>GSGTSYSLTISRVEAEDAATYYCQQWTSNPPTFGGGTKLEIKRSRGGGGSGG<br>GGSGGGGSLEQVQLQQPGAELVKPGASVKMSCKASGYTFTSYNMHWVKQ<br>TPGRGLEWIGAIYPGNGDTSYNQKFKGKATLTADKSSSTAYMQLSSLTSEDS<br>AVYYCARSTYYGGDWYFNVWGAGTTVTVSSAAATGAPPLGTQPDCNPTPE<br>NGEAPASTSPTQSLLVDSQASKTLPIPTSAPVALSSTGKPVLDAGPVLFWVIL<br>VLVVVGSSAFLLCHRRACRKRIRQKLHLCYPVQTSQPKLELVDSRPRRSST<br>QLRSGASVTEPVAEERGLMSQPLMETCHSVGAAYLESLPLQDASPAGGPSSP<br>RDLPEPRVSTEHTNNKIEKIYIMKADTVIVGTVKAELPEGRGLAGPAEPELEE<br>ELEADHTPHYPEQETEPPLGSCSDVMLSVEEEGKEDPLPTAASGK |  |
| 68 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKEIENTKQPSKSCHKPKAIVHIEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLLKSVVYFAIITCCLLRRTAFCCNGEKSGSGATNFSLLKQAGDVEE<br>NPGPMETDTLLLWVLLLWVPGSTGLPVLTQPPSVSVAPGKTARITCGGNNIG<br>SKSVHWYQQKPGQAPVLVVYDDSDRPSGIPERFSGSNSGNTATLTISRVEAG<br>DEADYYCQVWDSSSDYVVFGGGTKLTVLGSRGGGGSGGGGSGGGGSLEM<br>AEVQLVQSGAEVKKPGESLKISCKGSGYSFTSYWIGWVRQMPGKGLEWMGI<br>IYPGDSDTRYSPSFQGQVTISADKSISTAYLQWSSLKASDTAMYYCARQVWG<br>WQGGMYPRSNWWYNLDSWGQGTLVTVSSGGGGSGGGGSQIVLSQSPAILS<br>ASPGEKVTMTCRASSSVSYIHWFQQKPGSSPKPWIYATSNLASGVPVRFSGS<br>GSGTSYSLTISRVEAEDAATYYCQQWTSNPPTFGGGTKLEIKRSRGGGGSGG<br>GGSGGGGSLEQVQLQQPGAELVKPGASVKMSCKASGYTFTSYNMHWVKQ<br>TPGRGLEWIGAIYPGNGDTSYNQKFKGKATLTADKSSSTAYMQLSSLTSEDS<br>AVYYCARSTYYGGDWYFNVWGAGTTVTVSSEQKLISEEDLAAATGDRDPP<br>ATQPQETQGPPARPITVQPTEAWPRTSQGPSTRPVEVPGGRAVAAILGLGLV<br>LGLLGPLAILLALYLLRRDQRLPPDAHKPPGGGSFRTPIQEEQADAHSTLAKI | Construct combination 68 (anti-CD22-anti-CD19-caTCR-1 + anti-CD19-anti-CD20-CSR-5A) (construct 15 + anti-CD19-anti-CD20-CSR-5A) (construct 15 + anti-CD19 scFv + anti-CD20 scFv + myc tag + truncated OX40) |
| 69 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKEIENTKQPSKSCHKPKAIVHTEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLLKSVVYFAIITCCLLRRTAFCCNGEKSGSGATNFSLLKQAGDVEE<br>NPGPMETDTLLLWVLLLWVPGSTGLPVLTQPPSVSVAPGKTARITCGGNNIG<br>SKSVHWYQQKPGQAPVLVVYDDSDRPSGIPERFSGSNSGNTATLTISRVEAG<br>DEADYYCQVWDSSSDYVVFGGGTKLTVLGSRGGGGSGGGGSGGGGSLEM<br>AEVQLVQSGAEVKKPGESLKISCKGSGYSFTSYWIGWVRQMPGKGLEWMGI<br>IYPGDSDTRYSPSFQGQVTISADKSISTAYLQWSSLKASDTAMYYCARQVWG<br>WQGGMYPRSNWWYNLDSWGQGTLVTVSSGGGGSGGGGSQIVLSQSPAILS<br>ASPGEKVTMTCRASSSVSYIHWFQQKPGSSPKPWIYATSNLASGVPVRFSGS<br>GSGTSYSLTISRVEAEDAATYYCQQWTSNPPTFGGGTKLEIKRSRGGGGSGG<br>GGSGGGGSLEQVQLQQPGAELVKPGASVKMSCKASGYTFTSYNMHWVKQ<br>TPGRGLEWIGAIYPGNGDTSYNQKFKGKATLTADKSSSTAYMQLSSLTSEDS<br>AVYYCARSTYYGGDWYFNVWGAGTTVTVSSAAATGDRDPPATQPQETQGP | Construct combination 69 (anti-CD22-anti-CD19-caTCR-1 + anti-CD19-anti-CD20-CSR-5B) (construct 15 + anti-CD19-anti-CD20-CSR-5B) (construct 15 + anti-CD19 scFv + anti-CD20 scFv + truncated OX40) |

| SEQ ID NO. | Sequence | Notes |
|---|---|---|
| | PARPITVQPTEAWPRTSQGPSTRPVEVPGGRAVAAILGLGLVLGLLGPLAILL<br>ALYLLRRDQRLPPDAHKPPGGSFRTPIQEEQADAHSTLAKI | |
| 70 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKSCHKPKAIVHTEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLKSVVYFAIITCCLLRRTAFCCNGEKSGSGATNFSLLKQAGDVEE<br>NPGPMETDTLLLWVLLLWVPGSTGLPVLTQPPSVSVAPGKTARITCGGNNIG<br>SKSVHWYQQKPGQAPVLVVYDDSDRPSGIPERFSGSNSGNTATLTISRVEAG<br>DEADYYCQVWDSSSDYVVFGGGTKLTVLGSRGGGGSGGGGSGGGGSLEM<br>AEVQLVQSGAEVKKPGESLKISCKGSGYSFTSYWIGWVRQMPGKGLEWMGI<br>IYPGDSDTRYSPSFQGQVTISADKSISTAYLQWSSLKASDTAMYYCARQVWG<br>WQGGMYPRSNWWYNLDSWGQGTLVTVSSGGGGSGGGGSQIVLSQSPAILS<br>ASPGEKVTMTCRASSSVSYIHWFQQKPGSSPKPWIYATSNLASGVPVRFSGS<br>GSGTSYSLTISRVEAEDAATYYCQQWTSNPPTFGGGTKLEIKRSRGGGGSGG<br>GGSGGGGSLEQVQLQQPGAELVKPGASVKMSCKASGYTFTSYNMHWVKQ<br>TPGRGLEWIGAIYPGNGDTSYNQKFKGKATLTADKSSSTAYMQLSSLTSEDS<br>AVYYCARSTYYGGDWYFNVWGAGTTVTVSSEQKLISEEDLAAATGTTTPAP<br>RPPTPAPTIASQPLSLRPEACRPAAGGAVHTRGLDFACDIYIWAPLAGTCGVL<br>LLSLVITLYCQRRKYRSNKGESPVEPAEPCRYSCPREEEGSTIPIQEDYRKPEP<br>ACSP | Construct<br>combination 70<br>(anti-CD22-anti-<br>CD19-caTCR-1 +<br>anti-CD19-anti-<br>CD20-CSR-6A)<br>(construct 15 + anti-<br>CD19-anti-CD20-<br>CSR-6A)<br>(construct 15 + anti-<br>CD19 scFv + anti-<br>CD20 scFv + myc<br>tag + CD8 TM and<br>CD27 IC) |
| 71 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKSCHKPKAIVHTEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLKSVVYFAIITCCLLRRTAFCCNGEKSGSGATNFSLLKQAGDVEE<br>NPGPMETDTLLLWVLLLWVPGSTGLPVLTQPPSVSVAPGKTARITCGGNNIG<br>SKSVHWYQQKPGQAPVLVVYDDSDRPSGIPERFSGSNSGNTATLTISRVEAG<br>DEADYYCQVWDSSSDYVVFGGGTKLTVLGSRGGGGSGGGGSGGGGSLEM<br>AEVQLVQSGAEVKKPGESLKISCKGSGYSFTSYWIGWVRQMPGKGLEWMGI<br>IYPGDSDTRYSPSFQGQVTISADKSISTAYLQWSSLKASDTAMYYCARQVWG<br>WQGGMYPRSNWWYNLDSWGQGTLVTVSSGGGGSGGGGSQIVLSQSPAILS<br>ASPGEKVTMTCRASSSVSYIHWFQQKPGSSPKPWIYATSNLASGVPVRFSGS<br>GSGTSYSLTISRVEAEDAATYYCQQWTSNPPTFGGGTKLEIKRSRGGGGSGG<br>GGSGGGGSLEQVQLQQPGAELVKPGASVKMSCKASGYTFTSYNMHWVKQ<br>TPGRGLEWIGAIYPGNGDTSYNQKFKGKATLTADKSSSTAYMQLSSLTSEDS<br>AVYYCARSTYYGGDWYFNVWGAGTTVTVSSAAATGTTTPAPRPPTPAPTIA<br>SQPLSLRPEACRPAAGGAVHTRGLDFACDIYIWAPLAGTCGVLLLSLVITLYC<br>QRRKYRSNKGESPVEPAEPCRYSCPREEEGSTIPIQEDYRKPEPACSP | Construct<br>combination 71<br>(anti-CD22-anti-<br>CD19-caTCR-1 +<br>anti-CD19-anti-<br>CD20-CSR-6B)<br>(construct 15 + anti-<br>CD19-anti-CD20-<br>CSR-6B)<br>(construct 15 + anti-<br>CD19 scFv + anti-<br>CD20 scFv + CD8<br>TM and CD27 IC) |
| 72 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS | Construct<br>combination 72<br>(anti-CD22-anti-<br>CD19-caTCR-1 +<br>anti-CD19-anti-<br>CD20-CSR-7A)<br>(construct 15 + anti- |

| SEQ ID NO. | Sequence | Notes |
|---|---|---|
| | DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKEIENTKQPSKSCHKPKAIVHIEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLLKSVVYFAIITCCLLRRTAFCCNGEKSGSGATNFSLLKQAGDVEE<br>NPGPMETDTLLLWVLLLWVPGSTGLPVLTQPPSVSVAPGKTARITCGGNNIG<br>SKSVHWYQQKPGQAPVLVVYDDSDRPSGIPERFSGSNSGNTATLTISRVEAG<br>DEADYYCQVWDSSSDYVVFGGGTKLTVLGSRGGGGSGGGGSGGGGSLEM<br>AEVQLVQSGAEVKKPGESLKISCKGSGYSFTSYWIGWVRQMPGKGLEWMGI<br>IYPGDSDTRYSPSFQGQVTISADKSISTAYLQWSSLKASDTAMYYCARQVWG<br>WQGGMYPRSNWWYNLDSWGQGTLVTVSSGGGGSGGGGSQIVLSQSPAILS<br>ASPGEKVTMTCRASSSVSYIHWFQQKPGSSPKPWIYATSNLASGVPVRFSGS<br>GSGTSYSLTISRVEAEDAATYYCQQWTSNPPTFGGGTKLEIKRSRGGGGSGG<br>GGSGGGGSLEQVQLQQPGAELVKPGASVKMSCKASGYTFTSYNMHWVKQ<br>TPGRGLEWIGAIYPGNGDTSYNQKFKGKATLTADKSSSTAYMQLSSLTSEDS<br>AVYYCARSTYYGGDWYFNVWGAGTTVTVSSEQKLISEEDLAAATGTTTPAP<br>RPPTPAPTIASQPLSLRPEACRPAAGGAVHTRGLDFACDIYIWAPLAGTCGVL<br>LLSLVITLYCHRRACRKRIRQKLHLCYPVQTSQPKLELVDSRPRRSSTQLRSG<br>ASVTEPVAEERGLMSQPLMETCHSVGAAYLESLPLQDASPAGGPSSPRDLPE<br>PRVSTEHTNNKIEKIYIMKADTVIVGTVKAELPEGRGLAGPAEPELEEELEAD<br>HTPHYPEQEIEPPLGSCSDVMLSVEEEGKEDPLPTAASGK | CD19-anti-CD20-<br>CSR-7A)<br>(construct 15 + anti-<br>CD19 scFv + anti-<br>CD20 scFv + myc<br>tag + CD8 TM and<br>CD30 IC) |
| 73 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKSCHKPKAIVHIEKVNMMSLTVLGLRMLFAKTVAVNF<br>LLTAKLFFLRAKRSGSGAPVKQTLNFDLLKLAGDVESNPGPMETDTLLLWV<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLLKSVVYFAIITCCLLRRTAFCCNGEKSGSGATNFSLLKQAGDVEE<br>NPGPMETDTLLLWVLLLWVPGSTGLPVLTQPPSVSVAPGKTARITCGGNNIG<br>SKSVHWYQQKPGQAPVLVVYDDSDRPSGIPERFSGSNSGNTATLTISRVEAG<br>DEADYYCQVWDSSSDYVVFGGGTKLTVLGSRGGGGSGGGGSGGGGSLEM<br>AEVQLVQSGAEVKKPGESLKISCKGSGYSFTSYWIGWVRQMPGKGLEWMGI<br>IYPGDSDTRYSPSFQGQVTISADKSISTAYLQWSSLKASDTAMYYCARQVWG<br>WQGGMYPRSNWWYNLDSWGQGTLVTVSSGGGGSGGGGSQIVLSQSPAILS<br>ASPGEKVTMTCRASSSVSYIHWFQQKPGSSPKPWIYATSNLASGVPVRFSGS<br>GSGTSYSLTISRVEAEDAATYYCQQWTSNPPTFGGGTKLEIKRSRGGGGSGG<br>GGSGGGGSLEQVQLQQPGAELVKPGASVKMSCKASGYTFTSYNMHWVKQ<br>TPGRGLEWIGAIYPGNGDTSYNQKFKGKATLTADKSSSTAYMQLSSLTSEDS<br>AVYYCARSTYYGGDWYFNVWGAGTTVTVSSAAATGTTTPAPRPPTPAPTIA<br>SQPLSLRPEACRPAAGGAVHTRGLDFACDIYIWAPLAGTCGVLLLSLVITLYC<br>HRRACRKRIRQKLHLCYPVQTSQPKLELVDSRPRRSSTQLRSGASVTEPVAE<br>ERGLMSQPLMETCHSVGAAYLESLPLQDASPAGGPSSPRDLPEPRVSTEHTN<br>NKIEKIYIMKADTVIVGTVKAELPEGRGLAGPAEPELEEELEADHTPHYPEQE<br>TEPPLGSCSDVMLSVEEEGKEDPLPTAASGK | Construct<br>combination 73<br>(anti-CD22-anti-<br>CD19-caTCR-1 +<br>anti-CD19-anti-<br>CD20-CSR-7B)<br>(construct 15 + anti-<br>CD19-anti-CD20-<br>CSR-7B)<br>(construct 15 + anti-<br>CD19 scFv + anti-<br>CD20 scFv + CD8<br>TM and CD30 IC) |
| 74 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKETENTKQPSKSCHKPKAIVHIEKVNMMSLTVLGLRMLFAKTVAVNF<br>LLTAKLFFLRAKRSGSGAPVKQTLNFDLLKLAGDVESNPGPMETDTLLLWV | Construct<br>combination 74<br>CD19-caTCR-1 +<br>anti-CD 19-anti-<br>CD20-CSR-8A)<br>(anti-CD22-anti-<br>(construct 15 + anti-<br>CD19-anti-CD20-<br>CSR-8A)<br>(construct 15 + anti-<br>CD19 scFv + anti-<br>CD20 scFv + myc |

| SEQ ID NO. | Sequence | Notes |
|---|---|---|
| | LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLKSVVYFAIITCCLLRRTAFCCNGEKSGSGATNFSLLKQAGDVEE<br>NPGPMETDTLLLWVLLLWVPGSTGLPVLTQPPSVSVAPGKTARITCGGNNIG<br>SKSVHWYQQKPGQAPVLVVYDDSDRPSGIPERFSGSNSGNTATLTISRVEAG<br>DEADYYCQVWDSSSDYVVFGGGTKLTVLGSRGGGGSGGGGSGGGGSLEM<br>AEVQLVQSGAEVKKPGESLKISCKGSGYSFTSYWIGWVRQMPGKGLEWMGI<br>IYPGDSDTRYSPSFQGQVTISADKSISTAYLQWSSLKASDTAMYYCARQVWG<br>WQGGMYPRSNWWYNLDSWGQGTLVTVSSGGGGSGGGGSQIVLSQSPAILS<br>ASPGEKVTMTCRASSSVSYIHWFQQKPGSSPKPWIYATSNLASGVPVRFSGS<br>GSGTSYSLTISRVEAEDAATYYCQQWTSNPPTFGGGTKLEIKRSRGGGGSGG<br>GGSGGGGSLEQVQLQQPGAELVKPGASVKMSCKASGYTFTSYNMHWVKQ<br>TPGRGLEWIGAIYPGNGDTSYNQKFKGKATLTADKSSSTAYMQLSSLTSEDS<br>AVYYCARSTYYGGDWYFNVWGAGTTVTVSSEQKLISEEDLAAATGTTTPAP<br>RPPTPAPTIASQPLSLRPEACRPAAGGAVHTRGLDFACDIYIWAPLAGTCGVL<br>LLSLVITLYCALYLLRRDQRLPPDAHKPPGGSFRTPIQEEQADAHSTLAKI | tag + CD8 TM and OX40 IC) |
| 75 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSEVQLVQSGAEVKKPGESLKISCKGSGYSFTSYWIGWV<br>RQMPGKGLEWMGIIYPGDSDTRYSPSFQGQVTISADKSISTAYLQWSSLKAS<br>DTAMYYCARQVWGWQGGMYPRSNWWYNLDSWGQGTLVTVSSASTKGPS<br>VFPLAPSSKSTSGGTAALGCLVKDYFPEPVTVSWNSGALTSGVHTFPAVLQS<br>SGLYSLSSVVTVPSSSLGTQTYICNVNHKPSNTKVDKRVEPKSCEVKTDSTD<br>HVKPKEIENTKQPSKSCHKPKAIVHIEKVNMMSLTVLGLRMLFAKTVAVNF<br>LLLWVPGSTGLPVLTQPPSVSVAPGKTARITCGGNNIGSKSVHWYQQKPGQ<br>APVLVVYDDSDRPSGIPERFSGSNSGNTATLTISRVEAGDEADYYCQVWDSS<br>SDYVVFGGGTKLTVLGQPKANPTVTLFPPSSEELQANKATLVCLISDFYPGA<br>VTVAWKADGSPVKAGVETTKPSKQSNNKYAASSYLSLTPEQWKSHRSYSC<br>QVTHEGSTVEKTVAPTECSPIKTDVITMDPKDNCSKDANDTLLLQLTNTSAY<br>YMYLLLLLKSVVYFAIITCCLLRRTAFCCNGEKSGSGATNFSLLKQAGDVEE<br>NPGPMETDTLLLWVLLLWVPGSTGLPVLTQPPSVSVAPGKTARITCGGNNIG<br>SKSVHWYQQKPGQAPVLVVYDDSDRPSGIPERFSGSNSGNTATLTISRVEAG<br>DEADYYCQVWDSSSDYVVFGGGTKLTVLGSRGGGGSGGGGSGGGGSLEM<br>AEVQLVQSGAEVKKPGESLKISCKGSGYSFTSYWIGWVRQMPGKGLEWMGI<br>IYPGDSDTRYSPSFQGQVTISADKSISTAYLQWSSLKASDTAMYYCARQVWG<br>WQGGMYPRSNWWYNLDSWGQGTLVTVSSGGGGSGGGGSQIVLSQSPAILS<br>ASPGEKVTMTCRASSSVSYIHWFQQKPGSSPKPWIYATSNLASGVPVRFSGS<br>GSGTSYSLTISRVEAEDAATYYCQQWTSNPPTFGGGTKLEIKRSRGGGGSGG<br>GGSGGGGSLEQVQLQQPGAELVKPGASVKMSCKASGYTFTSYNMHWVKQ<br>TPGRGLEW<br>IGAIYPGNGDTSYNQKFKGKATLTADKSSSTAYMQLSSLTSEDSAVYYCARS<br>TYYGGDWYFNVWGAGTTVTVSSAAATGTTTPAPRPPTPAPTIASQPLSLRPE<br>ACRPAAGGAVHTRGLDFACDIYIWAPLAGTCGVLLLSLVITLYCALYLLRRD<br>QRLPPDAHKPPGGSFRTPIQEEQADAHSTLAKI | Construct combination 75 (anti-CD22-anti-CD19-caTCR-1 + anti-CD19-anti-CD20-CSR-8B) (construct 15 + anti-CD19-anti-CD20-CSR-8B) (construct 15 + anti-CD19 scFv + anti-CD20 scFv + CD8 TM and OX40 IC) |
| 76 | METDTLLLWVLLLWVPGSTGEVQLVQSGAEVKKPGESLKISCKGSGYSFTS<br>YWIGWVRQMPGKGLEWMGIIYPGDSDTRYSPSFQGQVTISADKSISTAYLQ<br>WSSLKASDTAMYYCARQVWGWQGGMYPRSNWWYNLDSWGQGTLVTVSS<br>ASTKGPSVFPLAPSSKSTSGGTAALGCLVKDYFPEPVTVSWNSGALTSGVHT<br>FPAVLQSSGLYSLSSVVTVPSSSLGTQTYICNVNHKPSNTKVDKRVEPKSCEV<br>KTDSTDHVKPKETENTKQPSKSCHKPKAIVHTEKVNMMSLTVLGLRMLFAK<br>TVAVNFLLTAKLFFLRAKRSGSGAPVKQTLNFDLLKLAGDVESNPGPMETD<br>TLLLWVLLLWVPGSTGLPVLTQPPSVSVAPGKTARITCGGNNIGSKSVHWY<br>QQKPGQAPVLVVYDDSDRPSGIPERFSGSNSGNTATLTISRVEAGDEADYYC<br>QVWDSSSDYVVFGGGTKLTVLGQPKANPTVTLFPPSSEELQANKATLVCLIS<br>DFYPGAVTVAWKADGSPVKAGVETTKPSKQSNNKYAASSYLSLTPEQWKS<br>HRSYSCQVTHEGSTVEKTVAP1ECSPIKTDVITMDPKDNCSKDANDTLLLQL<br>TNTSAYYMYLLLLLKSVVYFAIITCCLLRRTAFCCNGEKS | Anti-CD19-caTCR (SP-anti-CD19 VH-IgCH1-TCRdelta-F2A peptide-SP-anti-CD19 VL-IgCL-TCRgamma) |
| 77 | METDTLLLWVLLLWVPGSTGQVQLVESGGGLVQPGGSLRLSCAASGFTFSN<br>YAMSWVRQAPGKGLEWVSSISGSGGSTYYADSVKGRFTISRDTSKNTLYLQ<br>MNSLRAEDTAVYYCARYGSAAWMDSWGQGTLVTVSSASTKGPSVFPLAPS<br>SKSTSGGTAALGCLVKDYFPEPVTVSWNSGALTSGVHTFPAVLQSSGLYSLS<br>SVVTVPSSSLGTQTYICNVNHKPSNTKVDKRVEPKSCEVKTDSTDHVKPKET<br>ENTKQPSKSCHKPKAIVHTEKVNMMSLTVLGLRMLFAKTVAVNFLLTAKLF<br>FLRAKRSGSGAPVKQTLNFDLLKLAGDVESNPGPMETDTLLLWVLLLWVPG<br>STGDIQLTQSPSSLSTSVGDRVTITCQASHDIRNYLNWYQQKPGKAPNLLIYA<br>ASNLQTGVPSRFSGRGSGTDFTLTISSLQPEDIATYYCQQYDGLPLTFGQGTR | Anti-CD22-caTCR_monovalent (SP-anti-CD22 VH-IgCH1-TCRdelta-F2A peptide-SP-anti-CD22 VL-IgCLkappa-TCRgamma) |

| SEQ ID NO. | Sequence | Notes |
|---|---|---|
| | LEIKRTVAAPSVFIFPPSDEQLKSGTASVVCLLNNFYPREAKVQWKVDNALQ<br>SGNSQESVTEQDSKDSTYSLSSTLTLSKADYEKHKVYACEVTHQGLSSPVTK<br>SFNRGECPIKTDVITMDPKDNCSKDANDTLLLQLTNTSAYYMYLLLLLKSVV<br>YFAIITCCLLRRTAFCCNGEKS | |
| 78 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSGGGGSQVQLVESGGGLVQPGGSLRLSCAASGFTFSNYAMSWV<br>RQAPGKGLEWVSSISGSGGSTYYADSVKGRFTISRDTSKNTLYLQMNSLRAE<br>DTAVYYCARYGSAAWMDSWGQGTLVTVSSASTKGPSVFPLAPSSKSTSGGT<br>AALGCLVKDYFPEPVTVSWNSGALTSGVHTFPAVLQSSGLYSLSSVVTVPSS<br>SLGTQTYICNVNHKPSNTKVDKRVEPKSCEVKTDSTDHVKPKEIENTKQPSK<br>SCHKPKAIVHTEKVNMMSLTVLGLRMLFAKTVAVNFLLTAKLFFLRAKRSG<br>SGAPVKQTLNFDLLKLAGDVESNPGPMETDTLLLWVLLLWVPGSTGDIQLT<br>QSPSSLSTSVGDRVTITCQASHDIRNYLNWYQQKPGKAPNLLIYAASNLQTG<br>VPSRFSGRGSGTDFTLTISSLQPEDIATYYCQQYDGLPLTFGQGTRLEIKRTVA<br>APSVFIFPPSDEQLKSGTASVVCLLNNFYPREAKVQWKVDNALQSGNSQESV<br>TEQDSKDSTYSLSSTLTLSKADYEKHKVYACEVTHQGLSSPVTKSFNRGECPI<br>KTDVITMDPKDNCSKDANDTLLLQLTNTSAYYMYLLLLLKSVVYFAIITCCL<br>LRRTAFCCNGEKS | Anti-CD22-caTCR_bivalent |
| 79 | METDTLLLWVLLLWVPGSTGQVQLQQPGAELVKPGASVKMSCKASGYTFT<br>SYNMHWVKQTPGRGLEWIGAIYPGNGDTSYNQKFKGKATLTADKSSSTAY<br>MQLSSLTSEDSAVYYCARSTYYGGDWYFNVWGAGTTVTVSSASTKGPSVFP<br>LAPSSKSTSGGTAALGCLVKDYFPEPVTVSWNSGALTSGVHTFPAVLQSSGL<br>YSLSSVVTVPSSSLGTQTYICNVNHKPSNTKVDKRVEPKSCEVKTDSTDHVK<br>PKETENTKQPSKSCHKPKAIVHTEKVNMMSLTVLGLRMLFAKTVAVNFLLT<br>AKLFFLRAKRSGSGAPVKQTLNFDLLKLAGDVESNPGPMETDTLLLWVLLL<br>WVPGSTGQIVLSQSPAILSASPGEKVTMTCRASSSVSYIHWFQQKPGSSPKPW<br>IYATSNLASGVPVRFSGSGSGTSYSLTISRVEAEDAATYYCQQWTSNPPTFGG<br>GTKLEIKRTVAAPSVFIFPPSDEQLKSGTASVVCLLNNFYPREAKVQWKVDN<br>ALQSGNSQESVTEQDSKDSTYSLSSTLTLSKADYEKHKVYACEVTHQGLSSP<br>VTKSFNRGECPIKTDVITMDPKDNCSKDANDTLLLQLTNTSAYYMYLLLLLK<br>SVVYFAIITCCLLRRTAFCCNGEKS | Anti-CD20-caTCR (SP-anti-CD20 VH-IgCH1-TCRdelta-F2A peptide-SP-anti-CD20 VL-IgCLkappa-TCRgamma)_no FLAG tag |
| 80 | METDTLLLWVLLLWVPGSTGQVQLQQPGAELVKPGASVKMSCKASGYTFT<br>SYNMHWVKQTPGRGLEWIGAIYPGNGDTSYNQKFKGKATLTADKSSSTAY<br>MQLSSLTSEDSAVYYCARSTYYGGDWYFNVWGAGTTVTVSSASTKGPSVFP<br>LAPSSKSTSGGTAALGCLVKDYFPEPVTVSWNSGALTSGVHTFPAVLQSSGL<br>YSLSSVVTVPSSSLGTQTYICNVNHKPSNTKVDKRVEPKSCEVKTDSTDHVK<br>PKETENTKQPSKSCHKPKAIVHTEKVNMMSLTVLGLRMLFAKTVAVNFLLT<br>AKLFFLRAKRSGSGAPVKQTLNFDLLKLAGDVESNPGPMETDTLLLWVLLL<br>WVPGSTGQIVLSQSPAILSASPGEKVTMTCRASSSVSYIHWFQQKPGSSPKPW<br>IYATSNLASGVPVRFSGSGSGTSYSLTISRVEAEDAATYYCQQWTSNPPTFGG<br>GTKLEIKRTVAAPSVFIFPPSDEQLKSGTASVVCLLNNFYPREAKVQWKVDN<br>ALQSGNSQESVTEQDSKDSTYSLSSTLTLSKADYEKHKVYACEVTHQGLSSP<br>VTKSFNRGECPIKTDVITMDPKDNCSKDANDTLLLQLTNTSAYYMYLLLLLK<br>SVVYFAIITCCLLRRTAFCCNGEKSDYKDHDGDYKDHDIDYKDDDDK | Anti-CD20-caTCR (SP-anti-CD20 VH-IgCH1-TCRdelta-F2A peptide-SP-anti-CD20 VL-IgCLkappa-TCRgamma-FLAG tag) |
| 81 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSVTVSSEQKLISEEDLAAATGPADLSPGASSVTPPAPAREPGHSP<br>QIISFFLALTSTALLFLLFFLTLRFSVVKRGRKKLLYIFKQPFMRPVQTTQEED<br>GCSCRFPEEEEGGCEL | Anti-CD19-CSR-1A (with myc tag + truncated CD28) |
| 82 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSAAATGPADLSPGASSVTPPAPAREPGHSPQIISFFLALTS<br>TALLFLLFFLTLRFSVVKRGRKKLLYIFKQPFMRPVQTTQEEDGCSCRFPEEE<br>EGGCEL | Anti-CD19-CSR-1B (with truncated CD28) |
| 83 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG | Anti-CD19-CSR-2A (with myc tag + truncated 4-1BB) |

| SEQ ID NO. | Sequence | Notes |
|---|---|---|
| | QGTLVTVSSVTVSSEQKLISEEDLAAATGPTHLPYVSEMLEARTAGHMQTLA DFRQLPARTLSTHWPPQRSLCSSDFIRILVIFSGMFLVFTLAGALFLHQRRKY RSNKGESPVEPAEPCRYSCPREEEGSTIPIQEDYRKPEPACSP | |
| 84 | METDTLLLWVLLLWVPGSTGDIQLTQSPSSLSTSVGDRVTITCQASHDIRNYL NWYQQKPGKAPNLLIYAASNLQTGVPSRFSGRGSGTDFTLTISSLQPEDIATY YCQQYDGLPLTFGQGTRLEIKRSRGGGGSGGGGSGGGGSLEMAQVQLVESG GGLVQPGGSLRLSCAASGFTFSNYAMSWVRQAPGKGLEWVSSISGSGGSTY YADSVKGRFTISRDTSKNTLYLQMNSLRAEDTAVYYCARYGSAAWMDSWG QGTLVTVSSVTVSSAAATGPTHLPYVSEMLEARTAGHMQTLADFRQLPART LSTHWPPQRSLCSSDFIRILVIFSGMFLVFTLAGALFLHQRRKYRSNKGESPVE PAEPCRYSCPREEEGSTIPIQEDYRKPEPACSP | Anti-CD19-CSR-2B (truncated 4-1BB) |
| 85 | METDTLLLWVLLLWVPGSTGDIQLTQSPSSLSTSVGDRVTITCQASHDIRNYL NWYQQKPGKAPNLLIYAASNLQTGVPSRFSGRGSGTDFTLTISSLQPEDIATY YCQQYDGLPLTFGQGTRLEIKRSRGGGGSGGGGSGGGGSLEMAQVQLVESG GGLVQPGGSLRLSCAASGFTFSNYAMSWVRQAPGKGLEWVSSISGSGGSTY YADSVKGRFTISRDTSKNTLYLQMNSLRAEDTAVYYCARYGSAAWMDSWG QGTLVTVSSVTVSSEQKLISEEDLAAATGAPPLGTQPDCNPTPENGEAPASTS PTQSLLVDSQASKTLPIPTSAPVALSSTGKPVLDAGPVLFWVILVLVVVGSS AFLLCHRRACRKRIRQKLHLCYPVQTSQPKLELVDSRPRRSSTQLRSGASVT EPVAEERGLMSQPLMETCHSVGAAYLESLPLQDASPAGGPSSPRDLPEPRVS TEHTNNKIEKIYIMKADTVIVGTVKAELPEGRGLAGPAEPELEEELEADHTPH YPEQETEPPLGSCSDVMLSVEEEGKEDPLPTAASGK | Anti-CD19-CSR-3A (with myc tag + truncated CD27) |
| 86 | METDTLLLWVLLLWVPGSTGDIQLTQSPSSLSTSVGDRVTITCQASHDIRNYL NWYQQKPGKAPNLLIYAASNLQTGVPSRFSGRGSGTDFTLTISSLQPEDIATY YCQQYDGLPLTFGQGTRLEIKRSRGGGGSGGGGSGGGGSLEMAQVQLVESG GGLVQPGGSLRLSCAASGFTFSNYAMSWVRQAPGKGLEWVSSISGSGGSTY YADSVKGRFTISRDTSKNTLYLQMNSLRAEDTAVYYCARYGSAAWMDSWG QGTLVTVSSVTVSSAAATGAPPLGTQPDCNPTPENGEAPASTSPTQSLLVDSQ ASKTLPIPTSAPVALSSTGKPVLDAGPVLFWVILVLVVVGSSAFLLCHRRAC RKRIRQKLHLCYPVQTSQPKLELVDSRPRRSSTQLRSGASV1EPVAEERGLM SQPLMETCHSVGAAYLESLPLQDASPAGGPSSPRDLPEPRVSTEHTNNKIEKI YIMKADTVIVGTVKAELPEGRGLAGPAEPELEEELEADHTPHYPEQETEPPLG SCSDVMLSVEEEGKEDPLPTAASGK | Anti-CD19-CSR-3B (with truncated CD27) |
| 87 | METDTLLLWVLLLWVPGSTGDIQLTQSPSSLSTSVGDRVTITCQASHDIRNYL NWYQQKPGKAPNLLIYAASNLQTGVPSRFSGRGSGTDFTLTISSLQPEDIATY YCQQYDGLPLTFGQGTRLEIKRSRGGGGSGGGGSGGGGSLEMAQVQLVESG GGLVQPGGSLRLSCAASGFTFSNYAMSWVRQAPGKGLEWVSSISGSGGSTY YADSVKGRFTISRDTSKNTLYLQMNSLRAEDTAVYYCARYGSAAWMDSWG QGTLVTVSSVTVSSEQKLISEEDLAAATGDRDPPATQPQETQGPPARPITVQP TEAWPRTSQGPSTRPVEVPGGRAVAAILGLGLVLGLLGPLAILLALYLLRRD QRLPPDAHKPPGGGSFRTPIQEEQADAHSTLAKI | Anti-CD19-CSR-4A (with myc tag + truncated CD30) |
| 88 | METDTLLLWVLLLWVPGSTGDIQLTQSPSSLSTSVGDRVTITCQASHDIRNYL NWYQQKPGKAPNLLIYAASNLQTGVPSRFSGRGSGTDFTLTISSLQPEDIATY YCQQYDGLPLTFGQGTRLEIKRSRGGGGSGGGGSGGGGSLEMAQVQLVESG GGLVQPGGSLRLSCAASGFTFSNYAMSWVRQAPGKGLEWVSSISGSGGSTY YADSVKGRFTISRDTSKNTLYLQMNSLRAEDTAVYYCARYGSAAWMDSWG QGTLVTVSSVTVSSAAATGDRDPPATQPQETQGPPARPITVQPTEAWPRTSQ GPSTRPVEVPGGRAVAAILGLGLVLGLLGPLAILLALYLLRRDQRLPPDAHK PPGGGSFRTPIQEEQADAHSTLAKI | Anti-CD19-CSR-4B (with truncated CD30) |
| 89 | METDTLLLWVLLLWVPGSTGDIQLTQSPSSLSTSVGDRVTITCQASHDIRNYL NWYQQKPGKAPNLLIYAASNLQTGVPSRFSGRGSGTDFTLTISSLQPEDIATY YCQQYDGLPLTFGQGTRLEIKRSRGGGGSGGGGSGGGGSLEMAQVQLVESG GGLVQPGGSLRLSCAASGFTFSNYAMSWVRQAPGKGLEWVSSISGSGGSTY YADSVKGRFTISRDTSKNTLYLQMNSLRAEDTAVYYCARYGSAAWMDSWG QGTLVTVSSVTVSSEQKLISEEDLAAATGTTTPAPRPPTPAPTIASQPLSLRPE ACRPAAGGAVHTRGLDFACDIYIWAPLAGTCGVLLLSLVITLYCQRRKYRSN KGESPVEPAEPCRYSCPREEEGSTIPIQEDYRKPEPACSP | Anti-CD19-CSR-5A (with myc tag + truncated OX40) |
| 90 | METDTLLLWVLLLWVPGSTGDIQLTQSPSSLSTSVGDRVTITCQASHDIRNYL NWYQQKPGKAPNLLIYAASNLQTGVPSRFSGRGSGTDFTLTISSLQPEDIATY YCQQYDGLPLTFGQGTRLEIKRSRGGGGSGGGGSGGGGSLEMAQVQLVESG GGLVQPGGSLRLSCAASGFTFSNYAMSWVRQAPGKGLEWVSSISGSGGSTY YADSVKGRFTISRDTSKNTLYLQMNSLRAEDTAVYYCARYGSAAWMDSWG QGTLVTVSSVTVSSAAATGTTTPAPRPPTPAPTIASQPLSLRPEACRPAAGGA VHTRGLDFACDIYIWAPLAGTCGVLLLSLVITLYCQRRKYRSNKGESPVEPA EPCRYSCPREEEGSTIPIQEDYRKPEPACSP | Anti-CD19-CSR-5B (with truncated OX40) |

| SEQ ID NO. | Sequence | Notes |
|---|---|---|
| 91 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSVTVSSEQKLISEEDLAAATGTTTPAPRPPTPAPTIASQPLSLRPE<br>ACRPAAGGAVHTRGLDFACDIYIWAPLAGTCGVLLLSLVITLYCHRRACRK<br>RIRQKLHLCYPVQTSQPKLELVDSRPRRSSTQLRSGASVTEPVAEERGLMSQP<br>LMETCHSVGAAYLESLPLQDASPAGGPSSPRDLPEPRVSTEHTNNKIEKIYIM<br>KADTVIVGTVKAELPEGRGLAGPAEPELEEELEADHTPHYPEQETEPPLGSCS<br>DVMLSVEEEGKEDPLPTAASGK | Anti-CD19-CSR-6A (with myc tag + CD8 TM and CD27 IC) |
| 92 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSVTVSSAAATGTTTPAPRPPTPAPTIASQPLSLRPEACRPAAGGA<br>VHTRGLDFACDIYIWAPLAGTCGVLLLSLVITLYCHRRACRKRIRQKLHLCY<br>PVQTSQPKLELVDSRPRRSSTQLRSGASVTEPVAEERGLMSQPLMETCHSVG<br>AAYLESLPLQDASPAGGPSSPRDLPEPRVSTEHTNNKIEKIYIMKADTVIVGT<br>VKAELPEGRGLAGPAEPELEEELEADHTPHYPEQETEPPLGSCSDVMLSVEE<br>EGKEDPLPTAASGK | Anti-CD19-CSR-6B (with CD8 TM and CD27 IC) |
| 93 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSVTVSSEQKLISEEDLAAATGTTTPAPRPPTPAPTIASQPLSLRPE<br>ACRPAAGGAVHTRGLDFACDIYIWAPLAGTCGVLLLSLVITLYCALYLLRRD<br>QRLPPDAHKPPGGGSFRTPIQEEQADAHSTLAKI | Anti-CD19-CSR-7A (with myc tag + CD8 TM and CD30 IC) |
| 94 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSVTVSSAAATGTTTPAPRPPTPAPTIASQPLSLRPEACRPAAGGA<br>VHTRGLDFACDIYIWAPLAGTCGVLLLSLVITLYCALYLLRRDQRLPPDAHK<br>PPGGGSFRTPIQEEQADAHSTLAKI | Anti-CD19-CSR-7B (with CD8 TM and CD30 IC) |
| 95 | METDTLLLWVLLLWVPGSTGLPVLTQPPSVSVAPGKTARITCGGNNIGSKSV<br>HWYQQKPGQAPVLVVYDDSDRPSGIPERFSGSNSGNTATLTISRVEAGDEAD<br>YYCQVWDSSSDYVVFGGGTKLTVLGSRGGGGSGGGGSGGGGSLEMAEVQL<br>VQSGAEVKKPGESLKISCKGSGYSFTSYWIGWVRQMPGKGLEWMGITYPGD<br>SDTRYSPSFQGQVTISADKSISTAYLQWSSLKASDTAMYYCARQVWGWQG<br>GMYPRSNWWYNLDSWGQGTLVTVSSEQKLISEEDLAAATGTTTPAPRPPTP<br>APTIASQPLSLRPEACRPAAGGAVHTRGLDFACDIYIWAPLAGTCGVLLLSLV<br>ITLYCALYLLRRDQRLPPDAHKPPGGGSFRTPIQEEQADAHSTLAKI | Anti-CD19-CSR-8A (with myc tag + CD8 TM and OX40 IC) |
| 96 | METDTLLLWVLLLWVPGSTGLPVLTQPPSVSVAPGKTARITCGGNNIGSKSV<br>HWYQQKPGQAPVLVVYDDSDRPSGIPERFSGSNSGNTATLTISRVEAGDEAD<br>YYCQVWDSSSDYVVFGGGTKLTVLGSRGGGGSGGGGSGGGGSLEMAEVQL<br>VQSGAEVKKPGESLKISCKGSGYSFTSYWIGWVRQMPGKGLEWMGITYPGD<br>SDTRYSPSFQGQVTISADKSISTAYLQWSSLKASDTAMYYCARQVWGWQG<br>GMYPRSNWWYNLDSWGQGTLVTVSSAAATGTTTPAPRPPTPAPTIASQPLS<br>LRPEACRPAAGGAVHTRGLDFACDIYIWAPLAGTCGVLLLSLVITLYCALYL<br>LRRDQRLPPDAHKPPGGGSFRTPIQEEQADAHSTLAKI | Anti-CD19-CSR-8B (with CD8 TM and OX40 IC) |
| 97 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSVTVSSEQKLISEEDLAAAIEVMYPPPYLDNEKSNGTIIHVKGKH<br>LCPSPLFPGPSKPFWVLVVVGGVLACYSLLVTVAFIIFWVRSKRSLLHSDY<br>MNMTPRRPGPTRKHYQPYAPPRDFAAYRS | Anti-CD22-CSR-1A (with myc tag + truncated CD28) |
| 98 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSVTVSSAAAIEVMYPPPYLDNEKSNGTIIHVKGKHLCPSPLFPGP | Anti-CD22-CSR-1B (with truncated CD28) |

| SEQ ID NO. | Sequence | Notes |
|---|---|---|
| | SKPFWVLVVVGGVLACYSLLVTVAFBFWVRSKRSRLLHSDYMNMTPRRPG<br>PTRKHYQPYAPPRDFAAYRS | |
| 99 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSVTVSSEQKLISEEDLAAATGPADLSPGASSVTPPAPAREPGHSP<br>QIISFFLALTSTALLFLLFFLTLRFSVVKRGRKKLLYIFKQPFMRPVQTTQEED<br>GCSCRFPEEEEGGCEL | Anti-CD22-CSR-2A<br>(with myc tag +<br>truncated 4-1BB) |
| 100 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSVTVSSAAATGPADLSPGASSVTPPAPAREPGHSPQIISFFLALTS<br>TALLFLLFFLTLRFSVVKRGRKKLLYIFKQPFMRPVQTTQEEDGCSCRFPEEE<br>EGGCEL | Anti-CD22-CSR-2B<br>(with truncated 4-<br>1BB) |
| 101 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSVTVSSEQKLISEEDLAAATGPTHLPYVSEMLEARTAGHMQTLA<br>DFRQLPARTLSTHWPPQRSLCSSDFIRILVIFSGMFLVFTLAGALFLHQRRKY<br>RSNKGESPVEPAEPCRYSCPREEEGSTIPIQEDYRKPEPACSP | Anti-CD22-CSR-3A<br>(with myc tag +<br>truncated CD27) |
| 102 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSVTVSSAAATGPTHLPYVSEMLEARTAGHMQTLADFRQLPART<br>LSTHWPPQRSLCSSDFIRILVIFSGMFLVFTLAGALFLHQRRKYRSNKGESPVE<br>PAEPCRYSCPREEEGSTIPIQEDYRKPEPACSP | Anti-CD22-CSR-3B<br>(with truncated<br>CD27) |
| 103 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSVTVSSEQKLISEEDLAAATGAPPLGTQPDCNPTPENGEAPASTS<br>PTQSLLVDSQASKTLPIPTSAPVALSSTGKPVLDAGPVLFWVILVLVVVGSS<br>AFLLCHRRACRKIRQKLHLCYPVQTSQPKLELVDSRPRRSSTQLRSGASVT<br>EPVAEERGLMSQPLMETCHSVGAAYLESLPLQDASPAGGPSSPRDLPEPRVS<br>TEHTNNKIEKIYIMKADTVIVGTVKAELPEGRGLAGPAEPELEEELEADHTPH<br>YPEQETEPPLGSCSDVMLSVEEEGKEDPLPTAASGK | Anti-CD22-CSR-4A<br>(with myc tag +<br>truncated CD30) |
| 104 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSVTVSSAAATGAPPLGTQPDCNPTPENGEAPASTSPTQSLLVDSQ<br>ASKTLPIPTSAPVALSSTGKPVLDAGPVLFWVILVLVVVGSSAFLLCHRRAC<br>RKRIRQKLHLCYPVQTSQPKLELVDSRPRRSSTQLRSGASVTPVAEERGLM<br>SQPLMETCHSVGAAYLESLPLQDASPAGGPSSPRDLPEPRVSTEHTNNKIEKI<br>YIMKADTVIVGTVKAELPEGRGLAGPAEPELEEELEADHTPHYPEQETEPPLG<br>SCSDVMLSVEEEGKEDPLPTAASGK | Anti-CD22-CSR-4B<br>(with truncated<br>CD30) |
| 105 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSVTVSSEQKLISEEDLAAATGDRDPPATQPQETQGPPARPITVQP<br>TEAWPRTSQGPSTRPVEVPGGRAVAAILGLGLVLGLLGPLAILLALYLLRRD<br>QRLPPDAHKPPGGGSFRTPIQEEQADAHSTLAKI | Anti-CD22-CSR-5A<br>(with myc tag +<br>truncated OX40) |
| 106 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG | Anti-CD22-CSR-5B<br>(with truncated<br>OX40) |

| SEQ ID NO. | Sequence | Notes |
|---|---|---|
|  | GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSVTVSSAAATGDRDPPATQPQETQGPPARPITVQPTEAWPRTSQ<br>GPSTRPVEVPGGRAVAAILGLGLVLGLLGPLAILLALYLLRRDQRLPPDAHK<br>PPGGGSFRTPIQEEQADAHSTLAKI |  |
| 107 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSVTVSSEQKLISEEDLAAATGTTTPAPRPPTPAPTIASQPLSLRPE<br>ACRPAAGGAVHTRGLDFACDIYIWAPLAGTCGVLLLSLVITLYCQRRKYRSN<br>KGESPVEPAEPCRYSCPREEEGSTIPIQEDYRKPEPACSP | Anti-CD22-CSR-6A (with myc tag + CD8 TM and CD27 IC) |
| 108 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSVTVSSAAATGTTTPAPRPPTPAPTIASQPLSLRPEACRPAAGGA<br>VHTRGLDFACDIYIWAPLAGTCGVLLLSLVITLYCQRRKYRSNKGESPVEPA<br>EPCRYSCPREEEGSTIPIQEDYRKPEPACSP | Anti-CD22-CSR-6B (with CD8 TM and CD27 IC) |
| 109 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSVTVSSEQKLISEEDLAAATGTTTPAPRPPTPAPTIASQPLSLRPE<br>ACRPAAGGAVHTRGLDFACDIYIWAPLAGTCGVLLLSLVITLYCHRRACRK<br>RIRQKLHLCYPVQTSQPKLELVDSRPRRSSTQLRSGASVTEPVAEERGLMSQP<br>LMETCHSVGAAYLESLPLQDASPAGGPSSPRDLPEPRVSTEHTNNKIEKIYIM<br>KADTVIVGTVKAELPEGRGLAGPAEPELEEELEADHTPHYPEQETEPPLGSCS<br>DVMLSVEEEGKEDPLPTAASGK | Anti-CD22-CSR-7A (with myc tag + CD8 TM and CD30 IC) |
| 110 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSVTVSSAAATGTTTPAPRPPTPAPTIASQPLSLRPEACRPAAGGA<br>VHTRGLDFACDIYIWAPLAGTCGVLLLSLVITLYCHRRACRKRIRQKLHLCY<br>PVQTSQPKLELVDSRPRRSSTQLRSGASVTEPVAEERGLMSQPLMETCHSVG<br>AAYLESLPLQDASPAGGPSSPRDLPEPRVSTEHTNNKIEKIYIMKADTVIVGT<br>VKAELPEGRGLAGPAEPELEEELEADHTPHYPEQETEPPLGSCSDVMLSVEE<br>EGKEDPLPTAASGK | Anti-CD22-CSR-7B (with CD8 TM and CD30 IC) |
| 111 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSVTVSSEQKLISEEDLAAATGTTTPAPRPPTPAPTIASQPLSLRPE<br>ACRPAAGGAVHTRGLDFACDIYIWAPLAGTCGVLLLSLVITLYCALYLLRRD<br>QRLPPDAHKPPGGGSFRTPIQEEQADAHSTLAKI | Anti-CD22-CSR-8A (with myc tag + CD8 TM and OX40 IC) |
| 112 | METDTLLLWVLLLWVPGSTGDIQLTQSPSSLSTSVGDRVTITCQASHDIRNYL<br>NWYQQKPGKAPNLLIYAASNLQTGVPSRFSGRGSGTDFTLTISSLQPEDIATY<br>YCQQYDGLPLTFGQGTRLEIKRSRGGGGSGGGGSGGGGSLEMAQVQLVESG<br>GGLVQPGGSLRLSCAASGFTFSNYAMSWVRQAPGKGLEWVSSISGSGGSTY<br>YADSVKGRFTISRDTSKNTLYLQMNSLRAEDTAVYYCARYGSAAWMDSWG<br>QGTLVTVSSVTVSSAAATGTTTPAPRPPTPAPTIASQPLSLRPEACRPAAGGA<br>VHTRGLDFACDIYIWAPLAGTCGVLLLSLVITLYCALYLLRRDQRLPPDAHK<br>PPGGGSFRTPIQEEQADAHSTLAKI | Anti-CD22-CSR-8B (with CD8 TM and OX40 IC) |
| 113 | METDTLLLWVLLLWVPGSTGQIVLSQSPAILSASPGEKVTMTCRASSSVSYIH<br>WFQQKPGSSPKPWIYATSNLASGVPVRFSGSGSGTSYSLTISRVEAEDAATY<br>YCQQWTSNPPTFGGGTKLEIKRSRGGGGSGGGGSGGGGSLEQVQLQQPGAE<br>LVKPGASVKMSCKASGYTFTSYNMHWVKQTPGRGLEWIGAIYPGNGDTSY<br>NQKFKGKATLTADKSSSTAYMQLSSLTSEDSAVYYCARSTYYGGDWYFNV<br>WGAGTTVTVSSEQKLISEEDLAAAIEVMYPPPYLDNEKSNGTIIHVKGKHLC<br>PSPLFPGPSKPFWVLVVVGGVLACYSLLVTVAFIIFWVRSKRSRLLHSDYMN<br>MTPRRPGPTRKHYQPYAPPRDFAAYRS | Anti-CD20-CSR-1A (with myc tag + truncated CD28) |

| SEQ ID NO. | Sequence | Notes |
|---|---|---|
| 114 | METDTLLLWVLLLWVPGSTGQIVLSQSPAILSASPGEKVTMTCRASSSVSYIH WFQQKPGSSPKPWIYATSNLASGVPVRFSGSGSGTSYSLTISRVEAEDAATY YCQQWTSNPPTFGGGTKLEIKRSRGGGGSGGGGSGGGGSLEQVQLQQPGAE LVKPGASVKMSCKASGYTFTSYNMHWVKQTPGRGLEWIGAIYPGNGDTSY NQKFKGKATLTADKSSSTAYMQLSSLTSEDSAVYYCARSTYYGGDWYFNV WGAGTTVTVSSAAAIEVMYPPPYLDNEKSNGTIIHVKGKHLCPSPLFPGSKP FWVLVVVGGVLACYSLLVTVAFIIFWVRSKRSLLHSDYMNMTPRRPGPTR KHYQPYAPPRDFAAYRS | Anti-CD20-CSR-1B (with truncated CD28) |
| 115 | METDTLLLWVLLLWVPGSTGQIVLSQSPAILSASPGEKVTMTCRASSSVSYIH WFQQKPGSSPKPWIYATSNLASGVPVRFSGSGSGTSYSLTISRVEAEDAATY YCQQWTSNPPTFGGGTKLEIKRSRGGGGSGGGGSGGGGSLEQVQLQQPGAE LVKPGASVKMSCKASGYTFTSYNMHWVKQTPGRGLEWIGAIYPGNGDTSY NQKFKGKATLTADKSSSTAYMQLSSLTSEDSAVYYCARSTYYGGDWYFNV WGAGTTVTVSSEQKLISEEDLAAATGPADLSPGASSVTPPAPAREPGHSPQIIS FFLALTSTALLFLLFFLTLRFSVVKRGRKKLLYIFKQPFMRPVQTTQEEDGCS CRFPEEEEGGCEL | Anti-CD20-CSR-2A (with myc tag + truncated 4-1BB) |
| 116 | METDTLLLWVLLLWVPGSTGQIVLSQSPAILSASPGEKVTMTCRASSSVSYIH WFQQKPGSSPKPWIYATSNLASGVPVRFSGSGSGTSYSLTISRVEAEDAATY YCQQWTSNPPTFGGGTKLEIKRSRGGGGSGGGGSGGGGSLEQVQLQQPGAE LVKPGASVKMSCKASGYTFTSYNMHWVKQTPGRGLEWIGAIYPGNGDTSY NQKFKGKATLTADKSSSTAYMQLSSLTSEDSAVYYCARSTYYGGDWYFNV WGAGTTVTVSSAAATGPADLSPGASSVTPPAPAREPGHSPQIISFFLALTSTA LLFLLFFLTLRFSVVKRGRKKLLYIFKQPFMRPVQTTQEEDGCSCRFPEEEEG GCEL | Anti-CD20-CSR-2B (with truncated 4-1BB) |
| 117 | METDTLLLWVLLLWVPGSTGQIVLSQSPAILSASPGEKVTMTCRASSSVSYIH WFQQKPGSSPKPWIYATSNLASGVPVRFSGSGSGTSYSLTISRVEAEDAATY YCQQWTSNPPTFGGGTKLEIKRSRGGGGSGGGGSGGGGSLEQVQLQQPGAE LVKPGASVKMSCKASGYTFTSYNMHWVKQTPGRGLEWIGAIYPGNGDTSY NQKFKGKATLTADKSSSTAYMQLSSLTSEDSAVYYCARSTYYGGDWYFNV WGAGTTVTVSSEQKLISEEDLAAATGPTHLPYVSEMLEARTAGHMQTLADF RQLPARTLSTHWPPQRSLCSSDFIRILVIFSGMFLVFTLAGALFLHQRRKYRS NKGESPVEPAEPCRYSCPREEEGSTIPIQEDYRKPEPACSP | Anti-CD20-CSR-3A (wim myc tag + truncated CD27) |
| 118 | METDTLLLWVLLLWVPGSTGQIVLSQSPAILSASPGEKVTMTCRASSSVSYIH WFQQKPGSSPKPWIYATSNLASGVPVRFSGSGSGTSYSLTISRVEAEDAATY YCQQWTSNPPTFGGGTKLEIKRSRGGGGSGGGGSGGGGSLEQVQLQQPGAE LVKPGASVKMSCKASGYTFTSYNMHWVKQTPGRGLEWIGAIYPGNGDTSY NQKFKGKATLTADKSSSTAYMQLSSLTSEDSAVYYCARSTYYGGDWYFNV WGAGTTVTVSSAAATGPTHLPYVSEMLEARTAGHMQTLADFRQLPARTLST HWPPQRSLCSSDFIRILVIFSGMFLVFTLAGALFLHQRRKYRSNKGESPVEPA EPCRYSCPREEEGSTIPIQEDYRKPEPACSP | Anti-CD20-CSR-3B (with truncated CD27) |
| 119 | METDTLLLWVLLLWVPGSTGQIVLSQSPAILSASPGEKVTMTCRASSSVSYIH WFQQKPGSSPKPWIYATSNLASGVPVRFSGSGSGTSYSLTISRVEAEDAATY YCQQWTSNPPTFGGGTKLEIKRSRGGGGSGGGGSGGGGSLEQVQLQQPGAE LVKPGASVKMSCKASGYTFTSYNMHWVKQTPGRGLEWIGAIYPGNGDTSY NQKFKGKATLTADKSSSTAYMQLSSLTSEDSAVYYCARSTYYGGDWYFNV WGAGTTVTVSSEQKLISEEDLAAATGAPPLGTQPDCNPTPENGEAPASTSPT QSLLVDSQASKTLPIPTSAPVALSSTGKPVLDAGPVLFWVILVLVVVGSSAF LLCHRRACRKRIRQKLHLCYPVQTSQPKLELVDSRPRRSSTQLRSGASVTEP VAEERGLMSQPLMETCHSVGAAYLESLPLQDASPAGGPSSPRDLPEPRVSTE HTNNKIEKIYIMKADTVIVGTVKAELPEGRGLAGPAEPELEEELEADHTPHYP EQETEPPLGSCSDVMLSVEEEGKEDPLPTAASGK | Anti-CD20-CSR-4A (with myc tag + truncated CD30) |
| 120 | METDTLLLWVLLLWVPGSTGQIVLSQSPAILSASPGEKVTMTCRASSSVSYIH WFQQKPGSSPKPWIYATSNLASGVPVRFSGSGSGTSYSLTISRVEAEDAATY YCQQWTSNPPTFGGGTKLEIKRSRGGGGSGGGGSGGGGSLEQVQLQQPGAE LVKPGASVKMSCKASGYTFTSYNMHWVKQTPGRGLEWIGAIYPGNGDTSY NQKFKGKATLTADKSSSTAYMQLSSLTSEDSAVYYCARSTYYGGDWYFNV WGAGTTVTVSSAAATGAPPLGTQPDCNPTPENGEAPASTSPTQSLLVDSQAS KTLPIPTSAPVALSSTGKPVLDAGPVLFWVILVLVVVGSSAFLLCHRRACR KRIRQKLHLCYPVQTSQPKLELVDSRPRRSSTQLRSGASVTEPVAEERGLMS QPLMETCHSVGAAYLESLPLQDASPAGGPSSPRDLPEPRVSTEHTNNKIEKIY IMKADTVIVGTVKAELPEGRGLAGPAEPELEEELEADHTPHYPEQETEPPLGS CSDVMLSVEEEGKEDPLPTAASGK | Anti-CD20-CSR-4B (with truncated CD30) |
| 121 | METDTLLLWVLLLWVPGSTGQIVLSQSPAILSASPGEKVTMTCRASSSVSYIH WFQQKPGSSPKPWIYATSNLASGVPVRFSGSGSGTSYSLTISRVEAEDAATY YCQQWTSNPPTFGGGTKLEIKRSRGGGGSGGGGSGGGGSLEQVQLQQPGAE LVKPGASVKMSCKASGYTFTSYNMHWVKQTPGRGLEWIGAIYPGNGDTSY NQKFKGKATLTADKSSSTAYMQLSSLTSEDSAVYYCARSTYYGGDWYFNV WGAGTTVTVSSEQKLISEEDLAAATGDRDPPATQPQETQGPPARPITVQPTE | Anti-CD20-CSR-5A (with myc tag + truncated OX40) |

| SEQ ID NO. | Sequence | Notes |
|---|---|---|
| | AWPRTSQGPSTRPVEVPGGRAVAAILGLGLVLGLLGPLAILLALYLLRRDQR LPPDAHKPPGGGSFRTPIQEEQADAHSTLAKI | |
| 122 | METDTLLLWVLLLWVPGSTGQIVLSQSPAILSASPGEKVTMTCRASSSVSYIH WFQQKPGSSPKPWIYATSNLASGVPVRFSGSGSGTSYSLTISRVEAEDAATY YCQQWTSNPPTFGGGTKLEIKRSGGGGSGGGGSGGGGSLEQVQLQQPGAE LVKPGASVKMSCKASGYTFTSYNMHWVKQTPGRGLEWIGAIYPGNGDTSY NQKFKGKATLTADKSSSTAYMQLSSLTSEDSAVYYCARSTYYGGDWYFNV WGAGTTVTVSSAAATGDRDPPATQPQETQGPPARPITVQPTEAWPRTSQGPS TRPVEVPGGRAVAAILGLGLVLGLLGPLAILLALYLLRRDQRLPPDAHKPPG GGSFRTPIQEEQADAHSTLAKI | Anti-CD20-CSR-5B (with truncated OX40) |
| 123 | METDTLLLWVLLLWVPGSTGQIVLSQSPAILSASPGEKVTMTCRASSSVSYIH WFQQKPGSSPKPWIYATSNLASGVPVRFSGSGSGTSYSLTISRVEAEDAATY YCQQWTSNPPTFGGGTKLEIKRSGGGGSGGGGSGGGGSLEQVQLQQPGAE LVKPGASVKMSCKASGYTFTSYNMHWVKQTPGRGLEWIGAIYPGNGDTSY NQKFKGKATLTADKSSSTAYMQLSSLTSEDSAVYYCARSTYYGGDWYFNV WGAGTTVTVSSEQKLISEEDLAAATGTTTPAPRPPTPAPTIASQPLSLRPEACR PAAGGAVHTRGLDFACDIYIWAPLAGTCGVLLLSLVITLYCQRRKYRSNKGE SPVEPAEPCRYSCPREEEGSTIPIQEDYRKPEPACSP | Anti-CD20-CSR-6A (with myc tag + CD8 TM and CD27 IC) |
| 124 | METDTLLLWVLLLWVPGSTGQIVLSQSPAILSASPGEKVTMTCRASSSVSYIH WFQQKPGSSPKPWIYATSNLASGVPVRFSGSGSGTSYSLTISRVEAEDAATY YCQQWTSNPPTFGGGTKLEIKRSRGGGGSGGGGSGGGGSLEQVQLQQPGAE LVKPGASVKMSCKASGYTFTSYNMHWVKQTPGRGLEWIGAIYPGNGDTSY NQKFKGKATLTADKSSSTAYMQLSSLTSEDSAVYYCARSTYYGGDWYFNV WGAGTTVTVSSAAATGTTTPAPRPPTPAPTIASQPLSLRPEACRPAAGGAVH TRGLDFACDIYIWAPLAGTCGVLLLSLVITLYCQRRKYRSNKGESPVEPAEPC RYSCPREEEGSTIPIQEDYRKPEPACSP | Anti-CD20-CSR-6B (with CD8 TM and CD27 IC) |
| 125 | METDTLLLWVLLLWVPGSTGQIVLSQSPAILSASPGEKVTMTCRASSSVSYIH WFQQKPGSSPKPWIYATSNLASGVPVRFSGSGSGTSYSLTISRVEAEDAATY YCQQWTSNPPTFGGGTKLEIKRSRGGGGSGGGGSGGGGSLEQVQLQQPGAE LVKPGASVKMSCKASGYTFTSYNMHWVKQTPGRGLEWIGAIYPGNGDTSY NQKFKGKATLTADKSSSTAYMQLSSLTSEDSAVYYCARSTYYGGDWYFNV WGAGTTVTVSSEQKLISEEDLAAATGTTTPAPRPPTPAPTIASQPLSLRPEACR PAAGGAVHTRGLDFACDIYIWAPLAGTCGVLLLSLVITLYCHRRACRKRIRQ KLHLCYPVQTSQPKLELVDSRPRRSSTQLRSGASVTEPVAEERGLMSQPLME TCHSVGAAYLESLPLQDASPAGGPSSPRDLPEPRVSTEHTNNKIEKIYIMKAD TVIVGTVKAELPEGRGLAGPAEPELEEELEADHTPHYPEQETEPPLGSCSDV MLSVEEEGKEDPLPTAASGK | Anti-CD20-CSR-7A (with myc tag + CD8 TM and CD30 IC) |
| 126 | METDTLLLWVLLLWVPGSTGQIVLSQSPAILSASPGEKVTMTCRASSSVSYIH WFQQKPGSSPKPWIYATSNLASGVPVRFSGSGSGTSYSLTISRVEAEDAATY YCQQWTSNPPTFGGGTKLEIKRSGGGGSGGGGSGGGGSLEQVQLQQPGAE LVKPGASVKMSCKASGYTFTSYNMHWVKQTPGRGLEWIGAIYPGNGDTSY NQKFKGKATLTADKSSSTAYMQLSSLTSEDSAVYYCARSTYYGGDWYFNV WGAGTTVTVSSAAATGTTTPAPRPPTPAPTIASQPLSLRPEACRPAAGGAVH TRGLDFACDIYIWAPLAGTCGVLLLSLVITLYCHRRACRKRIRQKLHLCYPV QTSQPKLELVDSRPRRSSTQLRSGASVTEPVAEERGLMSQPLMETCHSVGAA YLESLPLQDASPAGGPSSPRDLPEPRVS1EHTNNKIEKIYIMKADTVIVGTVK AELPEGRGLAGPAEPELEEELEADHTPHYPEQETEPPLGSCSDVMLSVEEEG KEDPLPTAASGK | Anti-CD20-CSR-7B (with CD8 TM and CD30 IC) |
| 127 | METDTLLLWVLLLWVPGSTGQIVLSQSPAILSASPGEKVTMTCRASSSVSYIH WFQQKPGSSPKPWIYATSNLASGVPVRFSGSGSGTSYSLTISRVEAEDAATY YCQQWTSNPPTFGGGTKLEIKRSGGGGSGGGGSGGGGSLEQVQLQQPGAE LVKPGASVKMSCKASGYTFTSYNMHWVKQTPGRGLEWIGAIYPGNGDTSY NQKFKGKATLTADKSSSTAYMQLSSLTSEDSAVYYCARSTYYGGDWYFNV WGAGTTVTVSSEQKLISEEDLAAATGTTTPAPRPPTPAPTIASQPLSLRPEACR PAAGGAVHTRGLDFACDIYIWAPLAGTCGVLLLSLVITLYCALYLLRRDQRL PPDAHKPPGGGSFRTPIQEEQADAHSTLAKI | Anti-CD20-CSR-8A (with myc tag + CD8 TM and OX40 IC) |
| 128 | METDTLLLWVLLLWVPGSTGQIVLSQSPAILSASPGEKVTMTCRASSSVSYIH WFQQKPGSSPKPWIYATSNLASGVPVRFSGSGSGTSYSLTISRVEAEDAATY YCQQWTSNPPTFGGGTKLEIKRSGGGGSGGGGSGGGGSLEQVQLQQPGAE LVKPGASVKMSCKASGYTFTSYNMHWVKQTPGRGLEWIGAIYPGNGDTSY NQKFKGKATLTADKSSSTAYMQLSSLTSEDSAVYYCARSTYYGGDWYFNV WGAGTTVTVSSAAATGTTTPAPRPPTPAPTIASQPLSLRPEACRPAAGGAVH TRGLDFACDIYIWAPLAGTCGVLLLSLVITLYCALYLLRRDQRLPPDAHKPP GGGSFRTPIQEEQADAHSTLAKI | Anti-CD20-CSR-8B (with CD8 TM and OX40 IC) |

| SEQ ID NO. | Sequence | Notes |
|---|---|---|
| 129 | METDTLLLWVLLLWVPGSTGLPVLTQPPSVSVAPGKTARITCGGNNIGSKSV<br>HWYQQKPGQAPVLVVYDDSDRPSGIPERFSGSNSGNTATLTISRVEAGDEAD<br>YYCQVWDSSSDYVVFGGGTKLTVLGSRGGGGSGGGGSGGGGSLEMAEVQL<br>VQSGAEVKKPGESLKISCKGSGYSFTSYWIGWVRQMPGKGLEWMGITYPGD<br>SDTRYSPSFQGQVTISADKSISTAYLQWSSLKASDTAMYYCARQVWGWQG<br>GMYPRSNWWYNLDSWGQGTLVTVSSGGGGSGGGGSQIVLSQSPAILSASPG<br>EKVTMTCRASSSVSYIHWFQQKPGSSPKPWIYATSNLASGVPVRFSGSGSGT<br>SYSLTISRVEAEDAATYYCQQWTSNPPTFGGGTKLEIKRSRGGGGSGGGGS<br>GGGGSLEQVQLQQPGAELVKPGASVKMSCKASGYTFTSYNMHWVKQTPGRG<br>LEWIGAIYPGNGDTSYNQKFKGKATLTADKSSSTAYMQLSSLTSEDSAVYY<br>CARSTYYGGDWYFNVWGAGTTVTVSSEQKLISEEDLAAAIEVMYPPPYLDN<br>EKSNGTIIHVKGKHLCPSPLFPGPSKPFWVLVVVGGVLACYSLLVTVAFIIFW<br>VRSKRSRLLHSDYMNMTPRRPGPTRKHYQPYAPPRDFAAYRS | Anti-CD19-anti-<br>CD20-CSR-1A<br>(with myc tag +<br>truncated CD28) |
| 130 | METDTLLLWVLLLWVPGSTGLPVLTQPPSVSVAPGKTARITCGGNNIGSKSV<br>HWYQQKPGQAPVLVVYDDSDRPSGIPERFSGSNSGNTATLTISRVEAGDEAD<br>YYCQVWDSSSDYVVFGGGTKLTVLGSRGGGGSGGGGSGGGGSLEMAEVQL<br>VQSGAEVKKPGESLKISCKGSGYSFTSYWIGWVRQMPGKGLEWMGITYPGD<br>SDTRYSPSFQGQVTISADKSISTAYLQWSSLKASDTAMYYCARQVWGWQG<br>GMYPRSNWWYNLDSWGQGTLVTVSSGGGGSGGGGSQIVLSQSPAILSASPG<br>EKVTMTCRASSSVSYIHWFQQKPGSSPKPWIYATSNLASGVPVRFSGSGSGT<br>SYSLTISRVEAEDAATYYCQQWTSNPPTFGGGTKLEIKRSRGGGGSGGGGS<br>GGGGSLEQVQLQQPGAELVKPGASVKMSCKASGYTFTSYNMHWVKQTPGRG<br>LEWIGAIYPGNGDTSYNQKFKGKATLTADKSSSTAYMQLSSLTSEDSAVYY<br>CARSTYYGGDWYFNVWGAGTTVTVSSAAAIEVMYPPPYLDNEKSNGTIIHV<br>KGKHLCPSPLFPGPSKPFWVLVVVGGVLACYSLLVTVAFIIFWVRSKRSRLL<br>HSDYMNMTPRRPGPTRKHYQPYAPPRDFAAYRS | Anti-CD19-anti-<br>CD20-CSR-1B<br>(with truncated<br>CD28) |
| 131 | METDTLLLWVLLLWVPGSTGLPVLTQPPSVSVAPGKTARITCGGNNIGSKSV<br>HWYQQKPGQAPVLVVYDDSDRPSGIPERFSGSNSGNTATLTISRVEAGDEAD<br>YYCQVWDSSSDYVVFGGGTKLTVLGSRGGGGSGGGGSGGGGSLEMAEVQL<br>VQSGAEVKKPGESLKISCKGSGYSFTSYWIGWVRQMPGKGLEWMGITYPGD<br>SDTRYSPSFQGQVTISADKSISTAYLQWSSLKASDTAMYYCARQVWGWQG<br>GMYPRSNWWYNLDSWGQGTLVTVSSGGGGSGGGGSQIVLSQSPAILSASPG<br>EKVTMTCRASSSVSYIHWFQQKPGSSPKPWIYATSNLASGVPVRFSGSGSGT<br>SYSLTISRVEAEDAATYYCQQWTSNPPTFGGGTKLEIKRSRGGGGSGGGGS<br>GGGGSLEQVQLQQPGAELVKPGASVKMSCKASGYTFTSYNMHWVKQTPGRG<br>LEWIGAIYPGNGDTSYNQKFKGKATLTADKSSSTAYMQLSSLTSEDSAVYY<br>CARSTYYGGDWYFNVWGAGTTVTVSSEQKLISEEDLAAATGPADLSPGASS<br>VTPPAPAREPGHSPQIISFFLALTSTALLFLLFFLTLRFSVVKRGRKKLLYIFKQ<br>PFMRPVQTTQEEDGCSCRFPEEEEGGCEL | Anti-CD19-anti-<br>CD20-CSR-2A<br>(with myc tag +<br>truncated 4-1BB) |
| 132 | METDTLLLWVLLLWVPGSTGLPVLTQPPSVSVAPGKTARITCGGNNIGSKSV<br>HWYQQKPGQAPVLVVYDDSDRPSGIPERFSGSNSGNTATLTISRVEAGDEAD<br>YYCQVWDSSSDYVVFGGGTKLTVLGSRGGGGSGGGGSGGGGSLEMAEVQL<br>VQSGAEVKKPGESLKISCKGSGYSFTSYWIGWVRQMPGKGLEWMGITYPGD<br>SDTRYSPSFQGQVTISADKSISTAYLQWSSLKASDTAMYYCARQVWGWQG<br>GMYPRSNWWYNLDSWGQGTLVTVSSGGGGSGGGGSQIVLSQSPAILSASPG<br>EKVTMTCRASSSVSYIHWFQQKPGSSPKPWIYATSNLASGVPVRFSGSGSGT<br>SYSLTISRVEAEDAATYYCQQWTSNPPTFGGGTKLEIKRSRGGGGSGGGGS<br>GGGGSLEQVQLQQPGAELVKPGASVKMSCKASGYTFTSYNMHWVKQTPGRG<br>LEWIGAIYPGNGDTSYNQKFKGKATLTADKSSSTAYMQLSSLTSEDSAVYY<br>CARSTYYGGDWYFNVWGAGTTVTVSSAAATGPADLSPGASSVTPPAPAREP<br>GHSPQIISFFLALTSTALLFLLFFLTLRFSVVKRGRKKLLYIFKQPFMRPVQTT<br>QEEDGCSCRFPEEEEGGCEL | Anti-CD19-anti-<br>CD20-CSR-2B<br>(with truncated 4-<br>1BB) |
| 133 | METDTLLLWVLLLWVPGSTGLPVLTQPPSVSVAPGKTARITCGGNNIGSKSV<br>HWYQQKPGQAPVLVVYDDSDRPSGIPERFSGSNSGNTATLTISRVEAGDEAD<br>YYCQVWDSSSDYVVFGGGTKLTVLGSRGGGGSGGGGSGGGGSLEMAEVQL<br>VQSGAEVKKPGESLKISCKGSGYSFTSYWIGWVRQMPGKGLEWMGITYPGD<br>SDTRYSPSFQGQVTISADKSISTAYLQWSSLKASDTAMYYCARQVWGWQG<br>GMYPRSNWWYNLDSWGQGTLVTVSSGGGGSGGGGSQIVLSQSPAILSASPG<br>EKVTMTCRASSSVSYIHWFQQKPGSSPKPWIYATSNLASGVPVRFSGSGSGT<br>SYSLTISRVEAEDAATYYCQQWTSNPPTFGGGTKLEIKRSRGGGGSGGGGS<br>GGGGSLEQVQLQQPGAELVKPGASVKMSCKASGYTFTSYNMHWVKQTPGRG<br>LEWIGAIYPGNGDTSYNQKFKGKATLTADKSSSTAYMQLSSLTSEDSAVYY<br>CARSTYYGGDWYFNVWGAGTTVTVSSEQKLISEEDLAAATGPTHLPYVSEM<br>LEARTAGHMQTLADFRQLPARTLSTHWPPQRSLCSSDFIRILVIFSGMFLVFT<br>LAGALFLHQRRKYRSNKGESPVEPAEPCRYSCPREEEGSTIPIQEDYRKPEPA<br>CSP | Anti-CD19-anti-<br>CD20-CSR-3A<br>(with myc tag +<br>truncated CD27) |
| 134 | METDTLLLWVLLLWVPGSTGLPVLTQPPSVSVAPGKTARITCGGNNIGSKSV<br>HWYQQKPGQAPVLVVYDDSDRPSGIPERFSGSNSGNTATLTISRVEAGDEAD<br>YYCQVWDSSSDYVVFGGGTKLTVLGSRGGGGSGGGGSGGGGSLEMAEVQL<br>VQSGAEVKKPGESLKISCKGSGYSFTSYWIGWVRQMPGKGLEWMGITYPGD | Anti-CD19-anti-<br>CD20-CSR-3B<br>(with truncated<br>CD27) |

| SEQ ID NO. | Sequence | Notes |
|---|---|---|
| | SDTRYSPSFQGQVTISADKSISTAYLQWSSLKASDTAMYYCARQVWGWQG<br>GMYPRSNWWYNLDSWGQGTLVTVSSGGGGSGGGGSQIVLSQSPAILSASPG<br>EKVTMTCRASSSVSYIHWFQQKPGSSPKPWIYATSNLASGVPVRFSGSGSGT<br>SYSLTISRVEAEDAATYYCQQWTSNPPTFGGGTKLEIKRSRGGGGSGGGGSG<br>GGGSLEQVQLQQPGAELVKPGASVKMSCKASGYTFTSYNMHWVKQTPGRG<br>LEWIGAIYPGNGDTSYNQKFKGKATLTADKSSSTAYMQLSSLTSEDSAVYY<br>CARSTYYGGDWYFNVWGAGTTVTVSSAAATGPTHLPYVSEMLEARTAGH<br>MQTLADFRQLPARTLSTHWPPQRSLCSSDFIRILVIFSGMFLVFTLAGALFLH<br>QRRKYRSNKGESPVEPAEPCRYSCPREEEGSTIPIQEDYRKPEPACSP | |
| 135 | METDTLLLWVLLLWVPGSTGLPVLTQPPSVSVAPGKTARITCGGNNIGSKSV<br>HWYQQKPGQAPVLVVYDDSDRPSGIPERFSGSNSGNTATLTISRVEAGDEAD<br>YYCQVWDSSSDYVVFGGGTKLTVLGSRGGGGSGGGGSGGGGSLEMAEVQL<br>VQSGAEVKKPGESLKISCKGSGYSFTSYWIGWVRQMPGKGLEWMGITYPGD<br>SDTRYSPSFQGQVTISADKSISTAYLQWSSLKASDTAMYYCARQVWGWQG<br>GMYPRSNWWYNLDSWGQGTLVTVSSGGGGSGGGGSQIVLSQSPAILSASPG<br>EKVTMTCRASSSVSYIHWFQQKPGSSPKPWIYATSNLASGVPVRFSGSGSGT<br>SYSLTISRVEAEDAATYYCQQWTSNPPTFGGGTKLEIKRSRGGGGSGGGGSG<br>GGGSLEQVQLQQPGAELVKPGASVKMSCKASGYTFTSYNMHWVKQTPGRG<br>LEWIGAIYPGNGDTSYNQKFKGKATLTADKSSSTAYMQLSSLTSEDSAVYY<br>CARSTYYGGDWYFNVWGAGTTVTVSSEQKLISEEDLAAATGAPPLGTQPDC<br>NPTPENGEAPASTSPTQSLLVDSQASKTLPIPTSAPVALSSTGKPVLDAGPVLF<br>WVILVLVVVGSSAFLLCHRRACRKIRQKLHLCYPVQTSQPKLELVDSRPR<br>RSSTQLRSGASVTEPVAEERGLMSQPLMETCHSVGAAYLESLPLQDASPAGG<br>PSSPRDLPEPRVSTEHTNNKIEKIYIMKADTVIVGTVKAELPEGRGLAGPAEP<br>ELEEEELEADHTPHYPEQETEPPLGSCSDVMLSVEEEGKEDPLPTAASGK | Anti-CD19-anti-CD20-CSR-4A (with myc tag + truncated CD30) |
| 136 | METDTLLLWVLLLWVPGSTGLPVLTQPPSVSVAPGKTARITCGGNNIGSKSV<br>HWYQQKPGQAPVLVVYDDSDRPSGIPERFSGSNSGNTATLTISRVEAGDEAD<br>YYCQVWDSSSDYVVFGGGTKLTVLGSRGGGGSGGGGSGGGGSLEMAEVQL<br>VQSGAEVKKPGESLKISCKGSGYSFTSYWIGWVRQMPGKGLEWMGITYPGD<br>SDTRYSPSFQGQVTISADKSISTAYLQWSSLKASDTAMYYCARQVWGWQG<br>GMYPRSNWWYNLDSWGQGTLVTVSSGGGGSGGGGSQIVLSQSPAILSASPG<br>EKVTMTCRASSSVSYIHWFQQKPGSSPKPWIYATSNLASGVPVRFSGSGSGT<br>SYSLTISRVEAEDAATYYCQQWTSNPPTFGGGTKLEIKRSRGGGGSGGGGSG<br>GGGSLEQVQLQQPGAELVKPGASVKMSCKASGYTFTSYNMHWVKQTPGRG<br>LEWIGAIYPGNGDTSYNQKFKGKATLTADKSSSTAYMQLSSLTSEDSAVYY<br>CARSTYYGGDWYFNVWGAGTTVTVSSAAATGAPPLGTQPDCNPTPENGEA<br>PASTSPTQSLLVDSQASKTLPIPTSAPVALSSTGKPVLDAGPVLFWVILVLVV<br>VVGSSAFLLCHRRACRKIRQKLHLCYPVQTSQPKLELVDSRPRRSSTQLRS<br>GASVTEPVAEERGLMSQPLMETCHSVGAAYLESLPLQDASPAGGPSSPRDLP<br>EPRVSTEHTNNKIEKIYIMKADTVIVGTVKAELPEGRGLAGPAEPELEEELEA<br>DHTPHYPEQE1EPPLGSCSDVMLSVEEEGKEDPLPTAASGK | Anti-CD19-anti-CD20-CSR-4B (with truncated CD30) |
| 137 | METDTLLLWVLLLWVPGSTGLPVLTQPPSVSVAPGKTARITCGGNNIGSKSV<br>HWYQQKPGQAPVLVVYDDSDRPSGIPERFSGSNSGNTATLTISRVEAGDEAD<br>YYCQVWDSSSDYVVFGGGTKLTVLGSRGGGGSGGGGSGGGGSLEMAEVQL<br>VQSGAEVKKPGESLKISCKGSGYSFTSYWIGWVRQMPGKGLEWMGITYPGD<br>SDTRYSPSFQGQVTISADKSISTAYLQWSSLKASDTAMYYCARQVWGWQG<br>GMYPRSNWWYNLDSWGQGTLVTVSSGGGGSGGGGSQIVLSQSPAILSASPG<br>EKVTMTCRASSSVSYIHWFQQKPGSSPKPWIYATSNLASGVPVRFSGSGSGT<br>SYSLTISRVEAEDAATYYCQQWTSNPPTFGGGTKLEIKRSRGGGGSGGGGSG<br>GGGSLEQVQLQQPGAELVKPGASVKMSCKASGYTFTSYNMHWVKQTPGRG<br>LEWIGAIYPGNGDTSYNQKFKGKATLTADKSSSTAYMQLSSLTSEDSAVYY<br>CARSTYYGGDWYFNVWGAGTTVTVSSEQKLISEEDLAAATGDRDPPATQPQ<br>ETQGPPARPITVQPTEAWPRTSQGPSTRPVEVPGGRAVAAILGLGLVLGLLGP<br>LAILLLALYLLRRDQRLPPDAHKPPGGGSFRTPIQEEQADAHSTLAKI | Anti-CD19-anti-CD20-CSR-5A (with myc tag + truncated OX40) |
| 138 | METDTLLLWVLLLWVPGSTGLPVLTQPPSVSVAPGKTARITCGGNNIGSKSV<br>HWYQQKPGQAPVLVVYDDSDRPSGIPERFSGSNSGNTATLTISRVEAGDEAD<br>YYCQVWDSSSDYVVFGGGTKLTVLGSRGGGGSGGGGSGGGGSLEMAEVQL<br>VQSGAEVKKPGESLKISCKGSGYSFTSYWIGWVRQMPGKGLEWMGITYPGD<br>SDTRYSPSFQGQVTISADKSISTAYLQWSSLKASDTAMYYCARQVWGWQG<br>GMYPRSNWWYNLDSWGQGTLVTVSSGGGGSGGGGSQIVLSQSPAILSASPG<br>EKVTMTCRASSSVSYIHWFQQKPGSSPKPWIYATSNLASGVPVRFSGSGSGT<br>SYSLTISRVEAEDAATYYCQQWTSNPPTFGGGTKLEIKRSRGGGGSGGGGSG<br>GGGSLEQVQLQQPGAELVKPGASVKMSCKASGYTFTSYNMHWVKQTPGRG<br>LEWIGAIYPGNGDTSYNQKFKGKATLTADKSSSTAYMQLSSLTSEDSAVYY<br>CARSTYYGGDWYFNVWGAGTTVTVSSAAATGDRDPPATQPQETQGPPARPI<br>TVQPTEAWPRTSQGPSTRPVEVPGGRAVAAILGLGLVLGLLGPLAILLALYL<br>LRRDQRLPPDAHKPPGGGSFRTPIQEEQADAHSTLAKI | Anti-CD19-anti-CD20-CSR-5B (with truncated OX40) |

| SEQ ID NO. | Sequence | Notes |
|---|---|---|
| 139 | METDTLLLWVLLLWVPGSTGLPVLTQPPSVSVAPGKTARITCGGNNIGSKSV<br>HWYQQKPGQAPVLVVYDDSDRPSGIPERFSGSNSGNTATLTISRVEAGDEAD<br>YYCQVWDSSSDYVVFGGGTKLTVLGSRGGGGSGGGGSGGGGSLEMAEVQL<br>VQSGAEVKKPGESLKISCKGSGYSFTSYWIGWVRQMPGKGLEWMGITYPGD<br>SDTRYSPSFQGQVTISADKSISTAYLQWSSLKASDTAMYYCARQVWGWQG<br>GMYPRSNWWYNLDSWGQGTLVTVSSGGGGSGGGGSQIVLSQSPAILSASPG<br>EKVTMTCRASSSVSYIHWFQQKPGSSPKPWIYATSNLASGVPVRFSGSGSGT<br>SYSLTISRVEAEDAATYYCQQWTSNPPTFGGGTKLEIKRSRGGGGSGGGGS<br>GGGSLEQVQLQQPGAELVKPGASVKMSCKASGYTFTSYNMHWVKQTPGRG<br>LEWIGAIYPGNGDTSYNQKFKGKATLTADKSSSTAYMQLSSLTSEDSAVYY<br>CARSTYYGGDWYFNVWGAGTTVTVSSEQKLISEEDLAAATGTTTPAPRPPT<br>PAPTIASQPLSLRPEACRPAAGGAVHTRGLDFACDIYIWAPLAGTCGVLLLSL<br>VITLYCQRRKYRSNKGESPVEPAEPCRYSCPREEEGSTIPIQEDYRKPEPACSP | Anti-CD19-anti-CD20-CSR-6A (with myc tag + CD8 TM and CD27 IC) |
| 140 | METDTLLLWVLLLWVPGSTGLPVLTQPPSVSVAPGKTARITCGGNNIGSKSV<br>HWYQQKPGQAPVLVVYDDSDRPSGIPERFSGSNSGNTATLTISRVEAGDEAD<br>YYCQVWDSSSDYVVFGGGTKLTVLGSRGGGGSGGGGSGGGGSLEMAEVQL<br>VQSGAEVKKPGESLKISCKGSGYSFTSYWIGWVRQMPGKGLEWMGITYPGD<br>SDTRYSPSFQGQVTISADKSISTAYLQWSSLKASDTAMYYCARQVWGWQG<br>GMYPRSNWWYNLDSWGQGTLVTVSSGGGGSGGGGSQIVLSQSPAILSASPG<br>EKVTMTCRASSSVSYIHWFQQKPGSSPKPWIYATSNLASGVPVRFSGSGSGT<br>SYSLTISRVEAEDAATYYCQQWTSNPPTFGGGTKLEIKRSRGGGGSGGGGS<br>GGGSLEQVQLQQPGAELVKPGASVKMSCKASGYTFTSYNMHWVKQTPGRG<br>LEWIGAIYPGNGDTSYNQKFKGKATLTADKSSSTAYMQLSSLTSEDSAVYY<br>CARSTYYGGDWYFNVWGAGTTVTVSSAAATGTTTPAPRPPTPAPTIASQPLS<br>LRPEACRPAAGGAVHTRGLDFACDIYIWAPLAGTCGVLLLSLVITLYCQRRK<br>YRSNKGESPVEPAEPCRYSCPREEEGSTIPIQEDYRKPEPACSP | Anti-CD19-anti-CD20-CSR-6B (with CD8 TM and CD27 IC) |
| 141 | METDTLLLWVLLLWVPGSTGLPVLTQPPSVSVAPGKTARITCGGNNIGSKSV<br>HWYQQKPGQAPVLVVYDDSDRPSGIPERFSGSNSGNTATLTISRVEAGDEAD<br>YYCQVWDSSSDYVVFGGGTKLTVLGSRGGGGSGGGGSGGGGSLEMAEVQL<br>VQSGAEVKKPGESLKISCKGSGYSFTSYWIGWVRQMPGKGLEWMGITYPGD<br>SDTRYSPSFQGQVTISADKSISTAYLQWSSLKASDTAMYYCARQVWGWQG<br>GMYPRSNWWYNLDSWGQGTLVTVSSGGGGSGGGGSQIVLSQSPAILSASPG<br>EKVTMTCRASSSVSYIHWFQQKPGSSPKPWIYATSNLASGVPVRFSGSGSGT<br>SYSLTISRVEAEDAATYYCQQWTSNPPTFGGGTKLEIKRSRGGGGSGGGGS<br>GGGSLEQVQLQQPGAELVKPGASVKMSCKASGYTFTSYNMHWVKQTPGRG<br>LEWIGAIYPGNGDTSYNQKFKGKATLTADKSSSTAYMQLSSLTSEDSAVYY<br>CARSTYYGGDWYFNVWGAGTTVTVSSEQKLISEEDLAAATGTTTPAPRPPT<br>PAPTIASQPLSLRPEACRPAAGGAVHTRGLDFACDIYIWAPLAGTCGVLLLSL<br>VITLYCHRRACRKRIRQKLHLCYPVQTSQPKLELVDSRPRRSSTQLRSGASVT<br>EPVAEERGLMSQPLMETCHSVGAAYLESLPLQDASPAGGPSSPRDLPEPRVS<br>TEHTNNKIEKIYIMKADTVIVGTVKAELPEGRGLAGPAEPELEEELEADHTPH<br>YPEQETEPPLGSCSDVMLSVEEEGKEDPLPTAASGK | Anti-CD19-anti-CD20-CSR-7A (with myc tag + CD8 TM and CD30 IC) |
| 142 | METDTLLLWVLLLWVPGSTGLPVLTQPPSVSVAPGKTARITCGGNNIGSKSV<br>HWYQQKPGQAPVLVVYDDSDRPSGIPERFSGSNSGNTATLTISRVEAGDEAD<br>YYCQVWDSSSDYVVFGGGTKLTVLGSRGGGGSGGGGSGGGGSLEMAEVQL<br>VQSGAEVKKPGESLKISCKGSGYSFTSYWIGWVRQMPGKGLEWMGITYPGD<br>SDTRYSPSFQGQVTISADKSISTAYLQWSSLKASDTAMYYCARQVWGWQG<br>GMYPRSNWWYNLDSWGQGTLVTVSSGGGGSGGGGSQIVLSQSPAILSASPG<br>EKVTMTCRASSSVSYIHWFQQKPGSSPKPWIYATSNLASGVPVRFSGSGSGT<br>SYSLTISRVEAEDAATYYCQQWTSNPPTFGGGTKLEIKRSRGGGGSGGGGS<br>GGGSLEQVQLQQPGAELVKPGASVKMSCKASGYTFTSYNMHWVKQTPGRG<br>LEWIGAIYPGNGDTSYNQKFKGKATLTADKSSSTAYMQLSSLTSEDSAVYY<br>CARSTYYGGDWYFNVWGAGTTVTVSSAAATGTTTPAPRPPTPAPTIASQPLS<br>LRPEACRPAAGGAVHTRGLDFACDIYIWAPLAGTCGVLLLSLVITLYCHRRA<br>CRKRIRQKLHLCYPVQTSQPKLELVDSRPRRSSTQLRSGASVTEPVAEERGL<br>MSQPLMETCHSVGAAYLESLPLQDASPAGGPSSPRDLPEPRVSTEHTNNKIE<br>KIYIMKADTVIVGTVKAELPEGRGLAGPAEPELEEELEADHTPHYPEQE1EPP<br>LGSCSDVMLSVEEEGKEDPLPTAASGK | Anti-CD19-anti-CD20-CSR-7B (with CD8 TM and CD30 IC) |
| 143 | METDTLLLWVLLLWVPGSTGLPVLTQPPSVSVAPGKTARITCGGNNIGSKSV<br>HWYQQKPGQAPVLVVYDDSDRPSGIPERFSGSNSGNTATLTISRVEAGDEAD<br>YYCQVWDSSSDYVVFGGGTKLTVLGSRGGGGSGGGGSGGGGSLEMAEVQL<br>VQSGAEVKKPGESLKISCKGSGYSFTSYWIGWVRQMPGKGLEWMGITYPGD<br>SDTRYSPSFQGQVTISADKSISTAYLQWSSLKASDTAMYYCARQVWGWQG<br>GMYPRSNWWYNLDSWGQGTLVTVSSGGGGSGGGGSQIVLSQSPAILSASPG<br>EKVTMTCRASSSVSYIHWFQQKPGSSPKPWIYATSNLASGVPVRFSGSGSGT<br>SYSLTISRVEAEDAATYYCQQWTSNPPTFGGGTKLEIKRSRGGGGSGGGGS<br>GGGSLEQVQLQQPGAELVKPGASVKMSCKASGYTFTSYNMHWVKQTPGRG<br>LEWIGAIYPGNGDTSYNQKFKGKATLTADKSSSTAYMQLSSLTSEDSAVYY<br>CARSTYYGGDWYFNVWGAGTTVTVSSEQKLISEEDLAAATGTTTPAPRPPT<br>PAPTIASQPLSLRPEACRPAAGGAVHTRGLDFACDIYIWAPLAGTCGVLLLSL<br>VITLYCALYLLRRDQRLPPDAHKPPGGGSFRTPIQEEQADAHSTLAKI | Anti-CD19-anti-CD20-CSR-8A (with myc tag + CD8 TM and OX40 IC) |

-continued

| SEQ ID NO. | Sequence | Notes |
|---|---|---|
| 144 | METDTLLLWVLLLWVPGSTGLPVLTQPPSVSVAPGKTARITCGGNNIGSKSV HWYQQKPGQAPVLVVYDDSDRPSGIPERFSGSNSGNTATLTISRVEAGDEAD YYCQVWDSSSDYVVFGGGTKLTVLGSRGGGGSGGGGSGGGGSLEMAEVQL VQSGAEVKKPGESLKISCKGSGYSFTSYWIGWVRQMPGKGLEWMGITYPGD SDTRYSPSFQGQVTISADKSISTAYLQWSSLKASDTAMYYCARQVWGWQG GMYPRSNWWYNLDSWGQGTLVTVSSGGGGSGGGGSQIVLSQSPAILSASPG EKVTMTCRASSSVSYIHWFQQKPGSSPKPWIYATSNLASGVPVRFSGSGSGT SYSLTISRVEAEDAATYYCQQWTSNPPTFGGGTKLEIKRSRGGGGSGGGGS GGGGSLEQVQLQQPGAELVKPGASVKMSCKASGYTFTSYNMHWVKQTPGRG LEWIGAIYPGNGDTSYNQKFKGKATLTADKSSSTAYMQLSSLTSEDSAVYY CARSTYYGGDWYFNVWGAGTTVTVSSAAATGTTTPAPRPPTPAPTIASQPLS LRPEACRPAAGGAVHTRGLDFACDIYIWAPLAGTCGVLLLSLVITLYCALYL LRRDQRLPPDAHKPPGGGSFRTPIQEEQADAHSTLAKI | Anti-CD19-anti-CD20-CSR-8B (with CD8 TM and OX40 IC) |
| 145 | IYIWAPLAGTCGVLLLSLVIT | CD8 transmembrane (TM) sequence |
| 146 | IISFFLALTSTALLFLLFFLTLRFSVV | 4-1BB TM sequence |
| 147 | ILVIFSGMFLVFTLAGALFLH | CD27 TM sequence |
| 148 | FWVLVVVGGVLACYSLLVTVAFIIFWV | CD28 TM sequence |
| 149 | PVLDAGPVLFWVILVLVVVGSSAFLLC | CD30 TM sequence |
| 150 | VAAILGLGLVLGLLGPLAILL | OX40 TM sequence |
| 151 | KRGRKKLLYIFKQPFMRPVQTTQEEDGCSCRFPEEEEGGCEL | 4-1BB IC signaling sequence |
| 152 | QRRKYRSNKGESPVEPAEPCRYSCPREEEGSTIPIQEDYRKPEPACSP | CD27 IC signaling sequence |
| 153 | RSKRSRLLHSDYMNMTPRRPGPTRKHYQPYAPPRDFAAYRS | CD28 IC signaling sequence |
| 154 | HRRACRKRIRQKLHLCYPVQTSQPKLELVDSRPRRSSTQLRSGASVTEPVAE ERGLMSQPLMETCHSVGAAYLESLPLQDASPAGGPSSPRDLPEPRVSTEHTN NKIEKIYIMKADTVIVGTVKAELPEGRGLAGPAEPELEEELEADHTPHYPEQE TEPPLGSCSDVMLSVEEEGKEDPLPTAASGK | CD30 IC signaling sequence |
| 155 | ALYLLRRDQRLPPDAHKPPGGGSFRTPIQEEQADAHSTLAKI | OX40 IC signaling sequence |
| 156 | EQKLISEEDLAAAIEVMYPPPYLDNEKSNGTIIHVKGKHLCPSPLFPGPSKPF WVLVVVGGVLACYSLLVTVAFIIFWVRSKRSRLLHSDYMNMTPRRPGPTRK HYQPYAPPRDFAAYRS | myc tag + truncated CD28-1A |
| 157 | IEVMYPPPYLDNEKSNGTIIHVKGKHLCPSPLFPGPSKPFWVLVVVGGVLAC YSLLVTVAFIIFWVRSKRSRLLHSDYMNMTPRRPGPTRKHYQPYAPPRDFAA YRS | truncated CD28-1B |
| 158 | EQKLISEEDLAAATGPADLSPGASSVTPPAPAREPGHSPQIISFFLALTSTALLF LLFFLTLRFSVVKRGRKKLLYIFKQPFMRPVQTTQEEDGCSCRFPEEEEGGCE L | myc tag + truncated 4-1BB-2A |
| 159 | PADLSPGASSVTPPAPAREPGHSPQIISFFLALTSTALLFLLFFLTLRFSVVKRG RKKLLYIFKQPFMRPVQTTQEEDGCSCRFPEEEEGGCEL | truncated 4-1BB-2B |
| 160 | EQKLISEEDLAAATGPTHLPYVSEMLEARTAGHMQTLADFRQLPARTLSTH WPPQRSLCSSDFIRILVIFSGMFLVFTLAGALFLHQRRKYRSNKGESPVEPAEP CRYSCPREEEGSTIPIQEDYRKPEPACSP | myc tag + truncated CD27-3A |
| 161 | PTHLPYVSEMLEARTAGHMQTLADFRQLPARTLSTHWPPQRSLCSSDFIRILV IFSGMFLVFTLAGALFLHQRRKYRSNKGESPVEPAEPCRYSCPREEEGSTIPIQ EDYRKPEPACSP | truncated CD27-3B |
| 162 | EQKLISEEDLAAATGAPPLGTQPDCNPTPENGEAPASTSPTQSLLVDSQASKT LPIPTSAPVALSSTGKPVLDAGPVLFWVILVLVVVGSSAFLLCHRRACRKRI RQKLHLCYPVQTSQPKLELVDSRPRRSSTQLRSGASVTEPVAEERGLMSQPL METCHSVGAAYLESLPLQDASPAGGPSSPRDLPEPRVSTEHTNNKIEKIYIMK ADTVIVGTVKAELPEGRGLAGPAEPELEEELEADHTPHYPEQETEPPLGSCSD VMLSVEEEGKEDPLPTAASGK | myc tag + truncated CD30-4A |

| SEQ ID NO. | Sequence | Notes |
|---|---|---|
| 163 | APPLGTQPDCNPTPENGEAPASTSPTQSLLVDSQASKTLPIPTSAPVALSSTGK PVLDAGPVLFWVILVLVVVGSSAFLLCHRRACRKRIRQKLHLCYPVQTSQP KLELVDSRPRRSSTQLRSGASVTEPVAEERGLMSQPLMETCHSVGAAYLESL PLQDASPAGGPSSPRDLPEPRVSTEHTNNKIEKIYIMKADTVIVGTVKAELPE GRGLAGPAEPELEEELEADHTPHYPEQETEPPLGSCSDVMLSVEEEGKEDPLP TAASGK | truncated CD30-4B |
| 164 | EQKLISEEDLAAATGDRDPPATQPQETQGPPARPITVQPTEAWPRTSQGPSTR PVEVPGGRAVAAILGLGLVLGLLGPLAILLALYLLRRDQRLPPDAHKPPGGG SFRTPIQEEQADAHSTLAKI | myc tag + truncated OX40-5A |
| 165 | DRDPPATQPQETQGPPARPITVQP1EAWPRTSQGPSTRPVEVPGGRAVAAILG LGLVLGLLGPLAILLALYLLRRDQRLPPDAHKPPGGGSFRTPIQEEQADAHST LAKI | truncated OX40-5B |
| 166 | EQKLISEEDLAAATGTTTPAPRPPTPAPTIASQPLSLRPEACRPAAGGAVHTR GLDFACDIYIWAPLAGTCGVLLLSLVITLYCQRRKYRSNKGESPVEPAEPCR YSCPREEEGSTIPIQEDYRKPEPACSP | myc tag + CD8 TM IC and CD27-6A |
| 167 | TTTPAPRPPTPAPTIASQPLSLRPEACRPAAGGAVHTRGLDFACDIYIWAPLA GTCGVLLLSLVITLYCQRRKYRSNKGESPVEPAEPCRYSCPREEEGSTIPIQED YRKPEPACSP | CD8 TM and CD27 IC 6B |
| 168 | EQKLISEEDLAAATGTTTPAPRPPTPAPTIASQPLSLRPEACRPAAGGAVHTR GLDFACDIYIWAPLAGTCGVLLLSLVITLYCHRRACRKRIRQKLHLCYPVQT SQPKLELVDSRPRRSSTQLRSGASVTEPVAEERGLMSQPLMETCHSVGAAYL ESLPLQDASPAGGPSSPRDLPEPRVSTEHTNNKIEKIYIMKADTVIVGTVKAE LPEGRGLAGPAEPELEEELEADHTPHYPEQETEPPLGSCSDVMLSVEEEGKE DPLPTAASGK | myc tag + CD8 TM and CD30 IC-7A |
| 169 | TTTPAPRPPTPAPTIASQPLSLRPEACRPAAGGAVHTRGLDFACDIYIWAPLA GTCGVLLLSLVITLYCHRRACRKRIRQKLHLCYPVQTSQPKLELVDSRPRRSS TQLRSGASVTEPVAEERGLMSQPLMETCHSVGAAYLESLPLQDASPAGGPSS PRDLPEPRVSTEHTNNKIEKIYIMKADTVIVGTVKAELPEGRGLAGPAEPELE EELEADHTPHYPEQETEPPLGSCSDVMLSVEEEGKEDPLPTAASGK | CD8 TM and CD30 1C-7B |
| 170 | EQKLISEEDLAAATGTTTPAPRPPTPAPTIASQPLSLRPEACRPAAGGAVHTR GLDFACDIYIWAPLAGTCGVLLLSLVITLYCALYLLRRDQRLPPDAHKPPGG GSFRTPIQEEQADAHSTLAKI | myc tag + CD8 TM IC and OX40-8A |
| 171 | TTTPAPRPPTPAPTIASQPLSLRPEACRPAAGGAVHTRGLDFACDIYIWAPLA GTCGVLLLSLVITLYCALYLLRRDQRLPPDAHKPPGGGSFRTPIQEEQADAHS TLAKI | CD8 TM and OX40 IC-8B |
| 172 | EQKLISEEDLAAATGTTTPAPRPPTPAPTIASQPLSLRPEACRPAAGGAVHTR GLDFACDIYIWAPLAGTCGVLLLSLVITLYCKRGRKKLLYIFKQPFMRPVQTT QEEDGCSCRFPEEEEGGCEL | myc tag + CD8 TM sequence and 4-1BB IC signaling sequence |
| 173 | TTTPAPRPPTPAPTIASQPLSLRPEACRPAAGGAVHTRGLDFACDIYIWAPLA GTCGVLLLSLVITLYCKRGRKKLLYIFKQPFMRPVQTTQEEDGCSCRFPEEEE GGCEL | CD8 TM sequence and 4-1BB IC signaling sequence |
| 174 | EVQLVQSGAEVKKPGESLKISCKGSGYSFTSYWIGWVRQMPGKGLEWMGII YPGDSDTRYSPSFQGQVTISADKSISTAYLQWSSLKASDTAMYYCARQVWG WQGGMYPRSNWWYNLDSWGQGTLVTVSS | Anti-CD19 VH |
| 175 | LPVLTQPPSVSVAPGKTARITCGGNNIGSKSVHWYQQKPGQAPVLVVYDDS DRPSGIPERFSGSNSGNTATLTISRVEAGDEADYYCQVWDSSSDYVVFGGGT KLTVL | Anti-CD19 VL |
| 176 | QVQLVESGGGLVQPGGSLRLSCAASGFTFSNYAMSWVRQAPGKGLEWVSSI SGSGGSTYYADSVKGRFTISRDTSKNTLYLQMNSLRAEDTAVYYCARYGSA AWMDSWGQGTLVTVSS | Anti-CD22 VH |
| 177 | DIQLTQSPSSLSTSVGDRVTITCQASHDIRNYLNWYQQKPGKAPNLLIYAASN LQTGVPSRFSGRGSGTDFTLTISSLQPEDIATYYCQQYDGLPTFGQGTRLEIK R | Anti-CD22 VL |
| 178 | QVQLQQPGAELVKPGASVKMSCKASGYTFTSYNMHWVKQTPGRGLEWIGA IYPGNGDTSYNQKFKGKATLTADKSSSTAYMQLSSLTSEDSAVYYCARSTY YGGDWYFNVWGAGTTVTVSS | Anti-CD20 VH |

| SEQ ID NO. | Sequence | Notes |
|---|---|---|
| 179 | QIVLSQSPAILSASPGEKVTMTCRASSSVSYIHWFQQKPGSSPKPWIYATSNL ASGVPVRFSGSGSGTSYSLTISRVEAEDAATYYCQQWTSNPPTFGGGTKLEIK R | Anti-CD20 VL |
| 180 | ASTKGPSVFPLAPSSKSTSGGTAALGCLVKDYFPEPVTVSWNSGALTSGVHT FPAVLQSSGLYSLSSVVTVPSSSLGTQTYICNVNHKPSNTKVDKRVEPKSC | IgCH1 |
| 181 | ASTKGPSVFPLAPSSKSTSGGTAALGCLVKDYFPEPVTVSWNSGALTSGVHT FPAVLQSSGLYELVSVVTVPSSSLGTQTYICNVNHKPSNTKVDKRVEPKSC GQPKANPTVTLFPPSSEELQANKATLVCLISDFYPGAVTVAWKADGSPVKA | IgCH1 (S64E, S66V) |
| 182 | GVETTKPSKQSNNKYAASSYLSLTPEQWKSHRSYSCQVTHEGSTVEKTVAP TECS | IgCL |
| 183 | TVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNR GEC | IgCLkappa |
| 184 | TVAAPSVFIFPPSDEQLKSGTASVVCLLNNFYPREAKVQWKVDNALQSGNS QESVTEQDSKDSTYSLLSSLTLSKADYEKHKVYACEVTHQGLSSPVTKSFNR GEC | IgCLkappa (S69L, T71S) |
| 185 | LPVLTQPPSVSVAPGKTARITCGGNNIGSKSVHWYQQKPGQAPVLVVYDDS DRPSGIPERFSGSNSGNTATLTISRVEAGDEADYYCQVWDSSSDYVVFGGGT KLTVLGSRGGGGSGGGGSGGGGSLEMAEVQLVQSGAEVKKPGESLKISCKG SGYSFTSYWIGWVRQMPGKGLEWMGITYPGDSDTRYSPSFQGQVTISADKSI STAYLQWSSLKASDTAMYYCARQVWGWQGGMYPRSNWWYNLDSWGQG TLVTVSS | Anti-CD19 scFv (anti-CD19 VL + linker + anti-CD19 VH) |
| 186 | DIQLTQSPSSLSTSVGDRVTITCQASHDIRNYLNWYQQKPGKAPNLLIYAASN LQTGVPSRFSGRGSGTDFTLTISSLQPEDIATYYCQQYDGLPLTFGQGTRLEIK RSRGGGGSGGGGSGGGGSLEMAQVLVESGGGLVQPGGSLRLSCAASGFTF SNYAMSWVRQAPGKGLEWVSSISGSGGSTYYADSVKGRFTISRDTSKNTLY LQMNSLRAEDTAVYYCARYGSAAWMDSWGQGTLVTVSS | Anti-CD22 scFv (anti-CD22 VL + linker anti-CD22 VH) |
| 187 | QIVLSQSPAILSASPGEKVTMTCRASSSVSYIHWFQQKPGSSPKPWIYATSNL ASGVPVRFSGSGSGTSYSLTISRVEAEDAATYYCQQWTSNPPTFGGGTKLEIK RSRGGGGSGGGGSGGGGSLEQVQLQQPGAELVKPGASVKMSCKASGYTFT SYNMHWVKQTPGRGLEWIGAIYPGNGDTSYNQKFKGKATLTADKSSSTAY MQLSSLTSEDSAVYYCARSTYYGGDWYFNVWGAGTTVTVSS | Anti-CD20 scv (anti-CD20 VL + linker + anti-CD20 VH) |
| 188 | LPVLTQPPSVSVAPGKTARITCGGNNIGSKSVHWYQQKPGQAPVLVVYDDS DRPSGIPERFSGSNSGNTATLTISRVEAGDEADYYCQVWDSSSDYVVFGGGT KLTVLGSRGGGGSGGGGSGGGGSLEMAEVQLVQSGAEVKKPGESLKISCKG SGYSFTSYWIGWVRQMPGKGLEWMGITYPGDSDTRYSPSFQGQVTISADKSI STAYLQWSSLKASDTAMYYCARQVWGWQGGMYPRSNWWYNLDSWGQG TLVTVSSGGGGSGGGGSQIVLSQSPAILSASPGEKVTMTCRASSSVSYIHWFQ QKPGSSPKPWIYATSNLASGVPVRFSGSGSGTSYSLTISRVEAEDAATYYCQQ WTSNPPTFGGGTKLEIKRSRGGGGSGGGGSGGGGSLEQVQLQQPGAELVKP GASVKMSCKASGYTFTSYNMHWVKQTPGRGLEWIGAIYPGNGDTSYNQKF KGKATLTADKSSSTAYMQLSSLTSEDSAVYYCARSTYYGGDWYFNVWGAG TTVTVSS | Anti-CD19 scFv-linker-anti-CD20 scFv |
| 189 | METDTLLLWVLLLWVPGSTG | Signal peptide (SP) |
| 190 | RAKRSGSGAPVKQTLNFDLLKLAGDVESNPGP | F2A peptide |
| 191 | GSGATNFSLLKQAGDVEENPGP | P2A |
| 192 | EVKTDSTDHVKPKETENTKQPSKSCHKPKAIVHIEKVNMMSLTVLGLRMLF AKTVAVNFLLTAKLFFL | TCRdelta |
| 193 | PIKTDVITMDPKDNCSKDANDTLLLQLTNTSAYYMYLLLLLKSVVYFAIITC CLLRRTAFCCNGEKS | TCR gamma |
| 194 | EQKLISEEDL | Myc tag |
| 195 | DYKDHDGDYKDHDIDYKDDDDK | FLAG tag |
| 196 | GSRGGGGSGGGGSGGGGSLEMA | Linker |
| 197 | SRGGGGSGGGGSGGGGSLEMA | Linker |
| 198 | GGGGS | Linker |

| SEQ ID NO. | Sequence | Notes |
|---|---|---|
| 199 | GGGGSGGGGS | Linker |
| 200 | GGGGSGGGGSGGGGS | Linker |
| 201 | AAATG | Linker |
| 202 | AAA | Linker |
| 203 | TPLGDTTHTSG | Linker (IgG3 upper hinge |
| 204 | MHLLGPWLLLLVLEYLAFSDSSKWVFEHPETLYAWEGACVWIPCTYRALD GDLESFILFHNPEYNKNTSKFDGTRLYESTKDGKVPSEQKRVQFLGDKNKNC TLSIHPVHLNDSGQLGLRMESKTEKWMERIHLNVSERPFPPHIQLPPEIQESQE VTLTCLLNFSCYGYPIQLQWLLEGVPMRQAAVTSTSLTIKSVFTRSELKFSPQ WSHHGKIVTCQLQDADGKFLSNDTVQLNVKHTPKLEIKVTPSDAIVREGDS VTMTCEVSSNPEYTTVSWLKDGTSLKKQNTFTLNLREVTKDQSGKYCCQV SNDVGPGRSEEVFLQVQYAPEPSTVQILHSPAVEGSQVEFLCMSLANPLPTN YTWYHNGKEMQGRTEEKVHIPKILPWHAGTYSCVAENILGTGQRGPGAELD VQYPPKKVTTVIQNPMPIREGDTVTLSCNYNSSNPSVTRYEWKPHGAWEEPS LGVLKIQNVGWDNTTIACAACNSWCSWASPVALNVQYAPRDVRVRKIKPLS EIHSGNSVSLQCDFSSSHPKEVQFFWEKNGRLLGKESQLNFDSISPEDAGSYS CWVNNSIGQTASKAWTLEVLYAPRRLRVSMSPGDQVMEGKSATLTCESDA NPPVSHYTWFDWNNQSLPYHSQKLRLEPVKVQHSGAYWCQGTNSVGKGRS PLSTLTVYYSPETIGRRVAVGLGSCLAILILAICGLKLQRRWKRTQSQQGLQE NSSGQSFFVRNKKVRRAPLSEGPHSLGCYNPMMEDGISYTTLRFPEMNIPRT GDAESSEMQRPPPDCDDTVTYSALHKRQVGDYENVIPDFPEDEGIHYSELIQF GVGERPQAQENVDYVILKH | full-length human CD22 |
| 205 | DVQYPPKKVTTVIQNPMPIREGDTVTLSCNYNSSNPSVTRYEWKPHGAWEE PSLGVLKIQNVGWDNTTIACAACNSWCSWASPVALNVQYAPRDVRVRKIKP LSEIHSGNSVSLQCDFSSSHPKEVQFFWEKNGRLLGKESQLNFDSISPEDAGS YSCWVNNSIGQTASKAWTLEVLYAPRRLRVSMSPGDQVMEGKSATLTCES DANPPVSHYTWFDWNNQSLPYHSQKLRLEPVKVQHSGAYWCQGTNSVGK GRSPLSTLTVYYSPETIGRR | extracellular region containing domains 5-7 of CD22 |
| 206 | SSNIGNNY | Clone 1 LC-CDR1 |
| 207 | ENN | Clone 1 LC-CDR2 |
| 208 | GTWDSSLSAGAV | Clone 1 LC-CDR3 |
| 209 | GFTFSNYA | Clone 1 HC-CDR1 |
| 210 | ISGSGGST | Clone 1 HC-CDR2 |
| 211 | ARPYYDD | Clone 1 HC-CDR3 |
| 212 | QSVVTQPPSVSAAPGQKVTISCSGSSSNIGNNYVSWYQQLPGTAPKLLIYENN KRPSGIPDRFSGSKSGTSATLGITGLQTGDEADYYCGTWDSSLSAGAVFGGG TKLTVLG | Clone 1 LC variable region |
| 213 | EVQLVESGGGLVQPGGSLRLSCAASGFTFSNYAMSWVRQAPGKGLEWVSAI SGSGGSTYYADSVKGRFTISRDNSKNTLYLQMNSLRAEDTAVYYCARPYYD DWGQGTLVTVSS | Clone 1 HC variable region |
| 214 | HDIRNY | Clone 2 LC-CDR1 |
| 215 | AAS | Clone 2 LC-CDR2 |
| 216 | QQYDGLPLT | Clone 2 LC-CDR3 |
| 217 | ARYGSAAWMDS | Clone 2 HC-CDR3 |
| 218 | DIQLTQSPSSLSTSVGDRVTITCQASHDIRNYLNWYQQKPGKAPNLLIYAASN LQTGVPSRFSGRGSGTDFTLTISSLQPEDIATYYCQQYDGLPLTFGQGTRLEIK R | Clone 2 LC variable region |
| 219 | QVQLVESGGGLVQPGGSLRLSCAASGFTFSNYAMSWVRQAPGKGLEWVSSI SGSGGSTYYADSVKGRFTISRDTSKNTLYLQMNSLRAEDTAVYYCARYGSA AWMDSWGQGTLVTVSS | Clone 2 HC variable region |
| 220 | GGGGS | Linker |
| 221 | GGSG | Linker |

-continued

| SEQ ID NO. | Sequence | Notes |
|---|---|---|
| 222 | SGGG | Linker |
| 223 | GSGS | Linker |
| 224 | GSGSGS | Linker |
| 225 | GSGSGSGS | Linker |
| 226 | GSGSGSGSGS | Linker |
| 227 | GGSGGS | Linker |
| 228 | GGSGGSGGS | Linker |
| 229 | GGSGGSGGSGGS | Linker |
| 230 | GGSG | Linker |
| 231 | GGSGGGSG | Linker |
| 232 | GGSGGGSGGGSG | Linker |
| 233 | SRGGGGSGGGGSGGGGSLEMA | Linker |
| 234 | HHHHHH | His tag |
| 235 | YPYDVPDYA | HA peptide |
| 236 | YPYDVPDYAS | HA peptide |
| 237 | DYKDDDDK | FLAG peptide |
| 238 | EQKLISEEDL | Myc peptide |
| 239 | QSVVTQPPSVSAAPGQKVTISCSGSSSNIGNNYVSWYQQLPGTAPKLLIYENNKRPSGIPDRFSGSKSGTSATLGITGLQTGDEADYYCGTWDSSLSAGAVFGGGTKLTVLGSRGGGGSGGGGSGGGGSLEMAEVQLVESGGGLVQPGGSLRLSCAASGFTFSNYAMSWVRQAPGKGLEWVSAISGSGGSTYYADSVKGRFTISRDNSKNTLYLQMNSLRAEDTAVYYCARPYYDDWGQGTLVTVSSTSGQAGQHHHHHHGAYPYDVPDYAS | anti-CD22 scFv antibody |
| 240 | DIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSTSGQAGQHHHHHHGAYPYDVPDYAS | anti-CD22 scFv antibody |

One or more features from any embodiments described herein or in the figures may be combined with one or more features of any other embodiment described herein in the figures without departing from the scope of the disclosure.

All publications, patents and patent applications cited in this specification are herein incorporated by reference as if each individual publication or patent application were specifically and individually indicated to be incorporated by reference. Although the foregoing disclosure has been described in some detail by way of illustration and example for purposes of clarity of understanding, it will be readily apparent to those of ordinary skill in the art in light of the teachings of this disclosure that certain changes and modifications may be made thereto without departing from the spirit or scope of the appended claims.

SEQUENCE LISTING (244 sequences)

SEQ ID NO: 1 - protein, 1066 aa, Artificial Sequence
  Description of Artificial Sequence: Synthetic polypeptide
METDTLLLWVLLLWVPGSTGEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 2 - protein, 642 aa, Artificial Sequence
  Description of Artificial Sequence: Synthetic polypeptide
METDTLLLWVLLLWVPGSTGQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECPIKTDVITMDPKDNCSKDANDTLLLQLTNTSAYYMYLLLLLKSVVYFAIITCCLLRRTAFCCNGEKS

SEQ ID NO: 3 - protein, 1054 aa, Artificial Sequence
  Description of Artificial Sequence: Synthetic polypeptide
METDTLLLWVLLLWVPGSTGQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 4 - protein, 894 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECPIKTDVITMDPKDNCSKDANDTLLLQLTNTSAYYMYLLLLLKSVVYFAIITCCLLRRTAFCCNGEKS

SEQ ID NO: 5 - protein, 1316 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSEQKLISEEDLAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 6 - protein, 1303 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSEQKLISEEDLAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 7 - protein, 1309 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSEQKLISEEDLAAATGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCEL

SEQ ID NO: 8 - protein, 1292 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSEQKLISEEDLAAATGPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 9 - protein, 1315 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSEQKLISEEDLAAATGTTTPAPRPPTPAPTIASQPLSLRPEACRPAAGGAVHTRGLDFACDIYIWAPLAGTCGVLLLSLVITLYCQRRKYRSNKGESPVEPAEPCRYSCPREEEGSTIPIQEDYRKPEPACSP

SEQ ID NO: 10 - protein, 1317 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSEQKLISEEDLAAATGPTHLPYVSEMLEARTAGHMQTLADFRQLPARTLSTHWPPQRSLCSSDFIRILVIFSGMFLVFTLAGALFLHQRRKYRSNKGESPVEPAEPCRYSCPREEEGSTIPIQEDYRKPEPACSP

SEQ ID NO: 11 - protein, 1455 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSEQKLISEEDLAAATGTTTPAPRPPTPAPTIASQPLSLRPEACRPAAGGAVHTRGLDFACDIYIWAPLAGTCGVLLLSLVITLYCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 12 - protein, 1468 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSEQKLISEEDLAAATGAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 13 - protein, 1309 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSEQKLISEEDLAAATGTTTPAPRPPTPAPTIASQPLSLRPEACRPAAGGAVHTRGLDFACDIYIWAPLAGTCGVLLLSLVITLYCALYLLRRDQRLPPDAHKPPGGGSFRTPIQEEQADAHSTLAKI

SEQ ID NO: 14 - protein, 1308 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSEQKLISEEDLAAATGDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 15 - protein, 906 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKS

SEQ ID NO: 16 - protein, 911 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKS

SEQ ID NO: 17 - protein, 944 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSTPLGDTTHTSGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSTPLGDTTHTSGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKS

SEQ ID NO: 18 - protein, 952 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSGGGGSGGGGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSGGGGSQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKS

SEQ ID NO: 19 - protein, 953 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSGGGGSGGGGSASTKGPSVFPLAPSSKSTSGGTAALGCLVKDYFPEPVTVSWNSGALTSGVHTFPAVLQSSGLYELVSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSGGGGSTVAAPSVFIFPPSDEQLKSGTASVVCLLNNFYPREAKVQWKVDNALQSGNSQESVTEQDSKDSTYSLLSSLTLSKADYEKHKVYACEVTHQGLSSPVTKSFNRGECPIKTDVITMDPKDNCSKDANDTLLLQLTNTSAYYMYLLLLLKSVVYFAIITCCLLRRTAFCCNGEKS

SEQ ID NO: 20 - protein, 901 aa, Artificial Sequence
  Description of Artificial Sequence: Synthetic polypeptide
METDTLLLWVLLLWVPGSTGEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGGGGGSGGGGSDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECPIKTDVITMDPKDNCSKDANDTLLLQLTNTSAYYMYLLLLLKSVVYFAIITCCLLRRTAFCCNGEKS

SEQ ID NO: 21 - protein, 900 aa, Artificial Sequence
  Description of Artificial Sequence: Synthetic polypeptide
METDTLLLWVLLLWVPGSTGQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRGGGGSGGGGSLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKS

SEQ ID NO: 22 - protein, 654 aa, Artificial Sequence
  Description of Artificial Sequence: Synthetic polypeptide
METDTLLLWVLLLWVPGSTGEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKS

SEQ ID NO: 23 - protein, 1328 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSEQKLISEEDLAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 24 - protein, 1183 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECPIKTDVITMDPKDNCSKDANDTLLLQLTNTSAYYMYLLLLLKSVVYFAIITCCLLRRTAFCCNGEKSDYKDHDGDYKDHDIDYKDDDDK

SEQ ID NO: 25 - protein, 1193 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSGGGGSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECPIKTDVITMDPKDNCSKDANDTLLLQLTNTSAYYMYLLLLLKSVVYFAIITCCLLRRTAFCCNGEKSDYKDHDGDYKDHDIDYKDDDDK

SEQ ID NO: 26 - protein, 1203 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSGGGGSGGGGSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECPIKTDVITMDPKDNCSKDANDTLLLQLTNTSAYYMYLLLLLKSVVYFAIITCCLLRRTAFCCNGEKSDYKDHDGDYKDHDIDYKDDDDK

SEQ ID NO: 27 - protein, 1176 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSGGGGSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRGGGGSGGGGSLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSDYKDHDGDYKDHDIDYKDDDDK

SEQ ID NO: 28 - protein, 666 aa, Artificial Sequence
  Description of Artificial Sequence: Synthetic polypeptide
METDTLLLWVLLLWVPGSTGQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECPIKTDVITMDPKDNCSKDANDTLLLQLTNTSAYYMYLLLLLKSVVYFAIITCCLLRRTAFCCNGEKSDYKDHDGDYKDHDIDYKDDDDK

SEQ ID NO: 29 - protein, 1318 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 30 - protein, 1317 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSEQKLISEEDLAAATGPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 31 - protein, 1307 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSAAATGPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 32 - protein, 1342 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSEQKLISEEDLAAATGPTHLPYVSEMLEARTAGHMQTLADFRQLPARTLSTHWPPQRSLCSSDFIRILVIFSGMFLVFTLAGALFLHQRRKYRSNKGESPVEPAEPCRYSCPREEEGSTIPIQEDYRKPEPACSP

SEQ ID NO: 33 - protein, 1332 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSAAATGPTHLPYVSEMLEARTAGHMQTLADFRQLPARTLSTHWPPQRSLCSSDFIRILVIFSGMFLVFTLAGALFLHQRRKYRSNKGESPVEPAEPCRYSCPREEEGSTIPIQEDYRKPEPACSP

SEQ ID NO: 34 - protein, 1493 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSEQKLISEEDLAAATGAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 35 - protein, 1483 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSAAATGAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 36 - protein, 1333 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSEQKLISEEDLAAATGDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 37 - protein, 1323 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSAAATGDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 38 - protein, 1340 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSEQKLISEEDLAAATGTTTPAPRPPTPAPTIASQPLSLRPEACRPAAGGAVHTRGLDFACDIYIWAPLAGTCGVLLLSLVITLYCQRRKYRSNKGESPVEPAEPCRYSCPREEEGSTIPIQEDYRKPEPACSP

SEQ ID NO: 39 - protein, 1330 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSAAATGTTTPAPRPPTPAPTIASQPLSLRPEACRPAAGGAVHTRGLDFACDIYIWAPLAGTCGVLLLSLVITLYCQRRKYRSNKGESPVEPAEPCRYSCPREEEGSTIPIQEDYRKPEPACSP

SEQ ID NO: 40 - protein, 1480 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSEQKLISEEDLAAATGTTTPAPRPPTPAPTIASQPLSLRPEACRPAAGGAVHTRGLDFACDIYIWAPLAGTCGVLLLSLVITLYCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 41 - protein, 1470 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSAAATGTTTPAPRPPTPAPTIASQPLSLRPEACRPAAGGAVHTRGLDFACDIYIWAPLAGTCGVLLLSLVITLYCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 42 - protein, 1334 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSEQKLISEEDLAAATGTTTPAPRPPTPAPTIASQPLSLRPEACRPAAGGAVHTRGLDFACDIYIWAPLAGTCGVLLLSLVITLYCALYLLRRDQRLPPDAHKPPGGGSFRTPIQEEQADAHSTLAKI

SEQ ID NO: 43 - protein, 1324 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSAAATGTTTPAPRPPTPAPTIASQPLSLRPEACRPAAGGAVHTRGLDFACDIYIWAPLAGTCGVLLLSLVITLYCALYLLRRDQRLPPDAHKPPGGGSFRTPIQEEQADAHSTLAKI

SEQ ID NO: 44 - protein, 1315 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSEQKLISEEDLAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 45 - protein, 1305 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 46 - protein, 1304 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSEQKLISEEDLAAATGPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 47 - protein, 1294 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSAAATGPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 48 - protein, 1329 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSEQKLISEEDLAAATGPTHLPYVSEMLEARTAGHMQTLADFRQLPARTLSTHWPPQRSLCSSDFIRILVIFSGMFLVFTLAGALFLHQRRKYRSNKGESPVEPAEPCRYSCPREEEGSTIPIQEDYRKPEPACSP

SEQ ID NO: 49 - protein, 1319 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSAAATGPTHLPYVSEMLEARTAGHMQTLADFRQLPARTLSTHWPPQRSLCSSDFIRILVIFSGMFLVFTLAGALFLHQRRKYRSNKGESPVEPAEPCRYSCPREEEGSTIPIQEDYRKPEPACSP

SEQ ID NO: 50 - protein, 1480 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSEQKLISEEDLAAATGAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 51 - protein, 1470 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSAAATGAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 52 - protein, 1320 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSEQKLISEEDLAAATGDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 53 - protein, 1310 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSAAATGDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 54 - protein, 1327 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSEQKLISEEDLAAATGTTTPAPRPPTPAPTIASQPLSLRPEACRPAAGGAVHTRGLDFACDIYIWAPLAGTCGVLLLSLVITLYCQRRKYRSNKGESPVEPAEPCRYSCPREEEGSTIPIQEDYRKPEPACSP

SEQ ID NO: 55 - protein, 1317 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSAAATGTTTPAPRPPTPAPTIASQPLSLRPEACRPAAGGAVHTRGLDFACDIYIWAPLAGTCGVLLLSLVITLYCQRRKYRSNKGESPVEPAEPCRYSCPREEEGSTIPIQEDYRKPEPACSP

SEQ ID NO: 56 - protein, 1467 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSEQKLISEEDLAAATGTTTPAPRPPTPAPTIASQPLSLRPEACRPAAGGAVHTRGLDFACDIYIWAPLAGTCGVLLLSLVITLYCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 57 - protein, 1457 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSAAATGTTTPAPRPPTPAPTIASQPLSLRPEACRPAAGGAVHTRGLDFACDIYIWAPLAGTCGVLLLSLVITLYCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 58 - protein, 1321 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSEQKLISEEDLAAATGTTTPAPRPPTPAPTIASQPLSLRPEACRPAAGGAVHTRGLDFACDIYIWAPLAGTCGVLLLSLVITLYCALYLLRRDQRLPPDAHKPPGGGSFRTPIQEEQADAHSTLAKI

SEQ ID NO: 59 - protein, 1311 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSAAATGTTTPAPRPPTPAPTIASQPLSLRPEACRPAAGGAVHTRGLDFACDIYIWAPLAGTCGVLLLSLVITLYCALYLLRRDQRLPPDAHKPPGGGSFRTPIQEEQADAHSTLAKI

SEQ ID NO: 60 - protein, 1585 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSEQKLISEEDLAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 61 - protein, 1575 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 62 - protein, 1574 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSEQKLISEEDLAAATGPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 63 - protein, 1564 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSAAATGPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 64 - protein, 1599 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSEQKLISEEDLAAATGPTHLPYVSEMLEARTAGHMQTLADFRQLPARTLSTHWPPQRSLCSSDFIRILVIFSGMFLVFTLAGALFLHQRRKYRSNKGESPVEPAEPCRYSCPREEEGSTIPIQEDYRKPEPACSP

SEQ ID NO: 65 - protein, 1589 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSAAATGPTHLPYVSEMLEARTAGHMQTLADFRQLPARTLSTHWPPQRSLCSSDFIRILVIFSGMFLVFTLAGALFLHQRRKYRSNKGESPVEPAEPCRYSCPREEEGSTIPIQEDYRKPEPACSP

SEQ ID NO: 66 - protein, 1750 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSEQKLISEEDLAAATGAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 67 - protein, 1740 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSAAATGAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 68 - protein, 1590 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSEQKLISEEDLAAATGDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 69 - protein, 1580 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSAAATGDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 70 - protein, 1597 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSEQKLISEEDLAAATGTTTPAPRPPTPAPTIASQPLSLRPEACRPAAGGAVHTRGLDFACDIYIWAPLAGTCGVLLLSLVITLYCQRRKYRSNKGESPVEPAEPCRYSCPREEEGSTIPIQEDYRKPEPACSP

SEQ ID NO: 71 - protein, 1587 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSAAATGTTTPAPRPPTPAPTIASQPLSLRPEACRPAAGGAVHTRGLDFACDIYIWAPLAGTCGVLLLSLVITLYCQRRKYRSNKGESPVEPAEPCRYSCPREEEGSTIPIQEDYRKPEPACSP

SEQ ID NO: 72 - protein, 1737 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSEQKLISEEDLAAATGTTTPAPRPPTPAPTIASQPLSLRPEACRPAAGGAVHTRGLDFACDIYIWAPLAGTCGVLLLSLVITLYCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 73 - protein, 1727 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSAAATGTTTPAPRPPTPAPTIASQPLSLRPEACRPAAGGAVHTRGLDFACDIYIWAPLAGTCGVLLLSLVITLYCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 74 - protein, 1591 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSEQKLISEEDLAAATGTTTPAPRPPTPAPTIASQPLSLRPEACRPAAGGAVHTRGLDFACDIYIWAPLAGTCGVLLLSLVITLYCALYLLRRDQRLPPDAHKPPGGGSFRTPIQEEQADAHSTLAKI

SEQ ID NO: 75 - protein, 1581 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSGSGATNFSLLKQAGDVEENPGPMETDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSAAATGTTTPAPRPPTPAPTIASQPLSLRPEACRPAAGGAVHTRGLDFACDIYIWAPLAGTCGVLLLSLVITLYCALYLLRRDQRLPPDAHKPPGGGSFRTPIQEEQADAHSTLAKI

SEQ ID NO: 76 - protein, 654 aa, Artificial Sequence; identical to SEQ ID NO: 22
  Description of Artificial Sequence: Synthetic polypeptide

SEQ ID NO: 77 - protein, 642 aa, Artificial Sequence; identical to SEQ ID NO: 2
  Description of Artificial Sequence: Synthetic polypeptide

SEQ ID NO: 78 - protein, 894 aa, Artificial Sequence; identical to SEQ ID NO: 4
  Description of Artificial Sequence: Synthetic polypeptide

SEQ ID NO: 79 - protein, 644 aa, Artificial Sequence
  Description of Artificial Sequence: Synthetic polypeptide
METDTLLLWVLLLWVPGSTGQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGAPVKQTLNFDLLKLAGDVESNPGPMETDTLLLWVLLLWVPGSTGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECPIKTDVITMDPKDNCSKDANDTLLLQLTNTSAYYMYLLLLLKSVVYFAIITCCLLRRTAFCCNGEKS

SEQ ID NO: 80 - protein, 666 aa, Artificial Sequence; identical to SEQ ID NO: 28
  Description of Artificial Sequence: Synthetic polypeptide

SEQ ID NO: 81 - protein, 399 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSEQKLISEEDLAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 82 - protein, 389 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 83 - protein, 388 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSEQKLISEEDLAAATGPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 84 - protein, 378 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSAAATGPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 85 - protein, 413 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSEQKLISEEDLAAATGPTHLPYVSEMLEARTAGHMQTLADFRQLPARTLSTHWPPQRSLCSSDFIRILVIFSGMFLVFTLAGALFLHQRRKYRSNKGESPVEPAEPCRYSCPREEEGSTIPIQEDYRKPEPACSP

SEQ ID NO: 86 - protein, 403 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSAAATGPTHLPYVSEMLEARTAGHMQTLADFRQLPARTLSTHWPPQRSLCSSDFIRILVIFSGMFLVFTLAGALFLHQRRKYRSNKGESPVEPAEPCRYSCPREEEGSTIPIQEDYRKPEPACSP

SEQ ID NO: 87 - protein, 564 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSEQKLISEEDLAAATGAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 88 - protein, 554 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSAAATGAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 89 - protein, 404 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSEQKLISEEDLAAATGDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 90 - protein, 394 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSAAATGDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 91 - protein, 411 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSEQKLISEEDLAAATGTTTPAPRPPTPAPTIASQPLSLRPEACRPAAGGAVHTRGLDFACDIYIWAPLAGTCGVLLLSLVITLYCQRRKYRSNKGESPVEPAEPCRYSCPREEEGSTIPIQEDYRKPEPACSP

SEQ ID NO: 92 - protein, 401 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSAAATGTTTPAPRPPTPAPTIASQPLSLRPEACRPAAGGAVHTRGLDFACDIYIWAPLAGTCGVLLLSLVITLYCQRRKYRSNKGESPVEPAEPCRYSCPREEEGSTIPIQEDYRKPEPACSP

SEQ ID NO: 93 - protein, 551 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSEQKLISEEDLAAATGTTTPAPRPPTPAPTIASQPLSLRPEACRPAAGGAVHTRGLDFACDIYIWAPLAGTCGVLLLSLVITLYCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 94 - protein, 541 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSAAATGTTTPAPRPPTPAPTIASQPLSLRPEACRPAAGGAVHTRGLDFACDIYIWAPLAGTCGVLLLSLVITLYCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 95 - protein, 406 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSEQKLISEEDLAAATGTTTPAPRPPTPAPTIASQPLSLRPEACRPAAGGAVHTRGLDFACDIYIWAPLAGTCGVLLLSLVITLYCALYLLRRDQRLPPDAHKPPGGGSFRTPIQEEQADAHSTLAKI

SEQ ID NO: 96 - protein, 396 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSAAATGTTTPAPRPPTPAPTIASQPLSLRPEACRPAAGGAVHTRGLDFACDIYIWAPLAGTCGVLLLSLVITLYCALYLLRRDQRLPPDAHKPPGGGSFRTPIQEEQADAHSTLAKI

SEQ ID NO: 97 - protein, 387 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSEQKLISEEDLAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 98 - protein, 377 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 99 - protein, 376 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSEQKLISEEDLAAATGPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 100 - protein, 366 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSAAATGPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 101 - protein, 401 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSEQKLISEEDLAAATGPTHLPYVSEMLEARTAGHMQTLADFRQLPARTLSTHWPPQRSLCSSDFIRILVIFSGMFLVFTLAGALFLHQRRKYRSNKGESPVEPAEPCRYSCPREEEGSTIPIQEDYRKPEPACSP

SEQ ID NO: 102 - protein, 391 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSAAATGPTHLPYVSEMLEARTAGHMQTLADFRQLPARTLSTHWPPQRSLCSSDFIRILVIFSGMFLVFTLAGALFLHQRRKYRSNKGESPVEPAEPCRYSCPREEEGSTIPIQEDYRKPEPACSP

SEQ ID NO: 103 - protein, 552 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSEQKLISEEDLAAATGAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 104 - protein, 542 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSAAATGAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 105 - protein, 392 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSEQKLISEEDLAAATGDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 106 - protein, 382 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSAAATGDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 107 - protein, 399 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSEQKLISEEDLAAATGTTTPAPRPPTPAPTIASQPLSLRPEACRPAAGGAVHTRGLDFACDIYIWAPLAGTCGVLLLSLVITLYCQRRKYRSNKGESPVEPAEPCRYSCPREEEGSTIPIQEDYRKPEPACSP

SEQ ID NO: 108 - protein, 389 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSAAATGTTTPAPRPPTPAPTIASQPLSLRPEACRPAAGGAVHTRGLDFACDIYIWAPLAGTCGVLLLSLVITLYCQRRKYRSNKGESPVEPAEPCRYSCPREEEGSTIPIQEDYRKPEPACSP

SEQ ID NO: 109 - protein, 539 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSEQKLISEEDLAAATGTTTPAPRPPTPAPTIASQPLSLRPEACRPAAGGAVHTRGLDFACDIYIWAPLAGTCGVLLLSLVITLYCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 110 - protein, 529 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSAAATGTTTPAPRPPTPAPTIASQPLSLRPEACRPAAGGAVHTRGLDFACDIYIWAPLAGTCGVLLLSLVITLYCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 111 - protein, 393 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSEQKLISEEDLAAATGTTTPAPRPPTPAPTIASQPLSLRPEACRPAAGGAVHTRGLDFACDIYIWAPLAGTCGVLLLSLVITLYCALYLLRRDQRLPPDAHKPPGGGSFRTPIQEEQADAHSTLAKI

SEQ ID NO: 112 - protein, 383 aa, Artificial Sequence
  Description of Artificial Sequence: Synthetic polypeptide
METDTLLLWVLLLWVPGSTGDIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSAAATGTTTPAPRPPTPAPTIASQPLSLRPEACRPAAGGAVHTRGLDFACDIYIWAPLAGTCGVLLLSLVITLYCALYLLRRDQRLPPDAHKPPGGGSFRTPIQEEQADAHSTLAKI

SEQ ID NO: 113 - protein, 387 aa, Artificial Sequence
  Description of Artificial Sequence: Synthetic polypeptide
METDTLLLWVLLLWVPGSTGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSEQKLISEEDLAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 114 - protein, 377 aa, Artificial Sequence
  Description of Artificial Sequence: Synthetic polypeptide
METDTLLLWVLLLWVPGSTGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 115 - protein, 376 aa, Artificial Sequence
  Description of Artificial Sequence: Synthetic polypeptide
METDTLLLWVLLLWVPGSTGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSEQKLISEEDLAAATGPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 116 - protein, 366 aa, Artificial Sequence
  Description of Artificial Sequence: Synthetic polypeptide
METDTLLLWVLLLWVPGSTGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSAAATGPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 117 - protein, 401 aa, Artificial Sequence
  Description of Artificial Sequence: Synthetic polypeptide
METDTLLLWVLLLWVPGSTGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSEQKLISEEDLAAATGPTHLPYVSEMLEARTAGHMQTLADFRQLPARTLSTHWPPQRSLCSSDFIRILVIFSGMFLVFTLAGALFLHQRRKYRSNKGESPVEPAEPCRYSCPREEEGSTIPIQEDYRKPEPACSP

SEQ ID NO: 118 - protein, 391 aa, Artificial Sequence
  Description of Artificial Sequence: Synthetic polypeptide
METDTLLLWVLLLWVPGSTGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSAAATGPTHLPYVSEMLEARTAGHMQTLADFRQLPARTLSTHWPPQRSLCSSDFIRILVIFSGMFLVFTLAGALFLHQRRKYRSNKGESPVEPAEPCRYSCPREEEGSTIPIQEDYRKPEPACSP

SEQ ID NO: 119 - protein, 552 aa, Artificial Sequence
  Description of Artificial Sequence: Synthetic polypeptide
METDTLLLWVLLLWVPGSTGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSEQKLISEEDLAAATGAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 120 - protein, 542 aa, Artificial Sequence
  Description of Artificial Sequence: Synthetic polypeptide
METDTLLLWVLLLWVPGSTGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSAAATGAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 121 - protein, 392 aa, Artificial Sequence
  Description of Artificial Sequence: Synthetic polypeptide
METDTLLLWVLLLWVPGSTGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSEQKLISEEDLAAATGDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 122 - protein, 382 aa, Artificial Sequence
  Description of Artificial Sequence: Synthetic polypeptide
METDTLLLWVLLLWVPGSTGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSAAATGDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 123 - protein, 399 aa, Artificial Sequence
  Description of Artificial Sequence: Synthetic polypeptide
METDTLLLWVLLLWVPGSTGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSEQKLISEEDLAAATGTTTPAPRPPTPAPTIASQPLSLRPEACRPAAGGAVHTRGLDFACDIYIWAPLAGTCGVLLLSLVITLYCQRRKYRSNKGESPVEPAEPCRYSCPREEEGSTIPIQEDYRKPEPACSP

SEQ ID NO: 124 - protein, 389 aa, Artificial Sequence
  Description of Artificial Sequence: Synthetic polypeptide
METDTLLLWVLLLWVPGSTGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSAAATGTTTPAPRPPTPAPTIASQPLSLRPEACRPAAGGAVHTRGLDFACDIYIWAPLAGTCGVLLLSLVITLYCQRRKYRSNKGESPVEPAEPCRYSCPREEEGSTIPIQEDYRKPEPACSP

SEQ ID NO: 125 - protein, 539 aa, Artificial Sequence
  Description of Artificial Sequence: Synthetic polypeptide
METDTLLLWVLLLWVPGSTGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSEQKLISEEDLAAATGTTTPAPRPPTPAPTIASQPLSLRPEACRPAAGGAVHTRGLDFACDIYIWAPLAGTCGVLLLSLVITLYCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 126 - protein, 529 aa, Artificial Sequence
  Description of Artificial Sequence: Synthetic polypeptide
METDTLLLWVLLLWVPGSTGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSAAATGTTTPAPRPPTPAPTIASQPLSLRPEACRPAAGGAVHTRGLDFACDIYIWAPLAGTCGVLLLSLVITLYCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 127 - protein, 393 aa, Artificial Sequence
  Description of Artificial Sequence: Synthetic polypeptide
METDTLLLWVLLLWVPGSTGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSEQKLISEEDLAAATGTTTPAPRPPTPAPTIASQPLSLRPEACRPAAGGAVHTRGLDFACDIYIWAPLAGTCGVLLLSLVITLYCALYLLRRDQRLPPDAHKPPGGGSFRTPIQEEQADAHSTLAKI

SEQ ID NO: 128 - protein, 383 aa, Artificial Sequence
  Description of Artificial Sequence: Synthetic polypeptide
METDTLLLWVLLLWVPGSTGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSAAATGTTTPAPRPPTPAPTIASQPLSLRPEACRPAAGGAVHTRGLDFACDIYIWAPLAGTCGVLLLSLVITLYCALYLLRRDQRLPPDAHKPPGGGSFRTPIQEEQADAHSTLAKI

SEQ ID NO: 129 - protein, 657 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSEQKLISEEDLAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 130 - protein, 647 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 131 - protein, 646 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSEQKLISEEDLAAATGPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 132 - protein, 636 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSAAATGPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 133 - protein, 671 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSEQKLISEEDLAAATGPTHLPYVSEMLEARTAGHMQTLADFRQLPARTLSTHWPPQRSLCSSDFIRILVIFSGMFLVFTLAGALFLHQRRKYRSNKGESPVEPAEPCRYSCPREEEGSTIPIQEDYRKPEPACSP

SEQ ID NO: 134 - protein, 661 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSAAATGPTHLPYVSEMLEARTAGHMQTLADFRQLPARTLSTHWPPQRSLCSSDFIRILVIFSGMFLVFTLAGALFLHQRRKYRSNKGESPVEPAEPCRYSCPREEEGSTIPIQEDYRKPEPACSP

SEQ ID NO: 135 - protein, 822 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSEQKLISEEDLAAATGAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 136 - protein, 812 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSAAATGAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 137 - protein, 662 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSEQKLISEEDLAAATGDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 138 - protein, 652 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSAAATGDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 139 - protein, 669 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSEQKLISEEDLAAATGTTTPAPRPPTPAPTIASQPLSLRPEACRPAAGGAVHTRGLDFACDIYIWAPLAGTCGVLLLSLVITLYCQRRKYRSNKGESPVEPAEPCRYSCPREEEGSTIPIQEDYRKPEPACSP

SEQ ID NO: 140 - protein, 659 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSAAATGTTTPAPRPPTPAPTIASQPLSLRPEACRPAAGGAVHTRGLDFACDIYIWAPLAGTCGVLLLSLVITLYCQRRKYRSNKGESPVEPAEPCRYSCPREEEGSTIPIQEDYRKPEPACSP

SEQ ID NO: 141 - protein, 809 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSEQKLISEEDLAAATGTTTPAPRPPTPAPTIASQPLSLRPEACRPAAGGAVHTRGLDFACDIYIWAPLAGTCGVLLLSLVITLYCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 142 - protein, 799 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSAAATGTTTPAPRPPTPAPTIASQPLSLRPEACRPAAGGAVHTRGLDFACDIYIWAPLAGTCGVLLLSLVITLYCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 143 - protein, 663 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSEQKLISEEDLAAATGTTTPAPRPPTPAPTIASQPLSLRPEACRPAAGGAVHTRGLDFACDIYIWAPLAGTCGVLLLSLVITLYCALYLLRRDQRLPPDAHKPPGGGSFRTPIQEEQADAHSTLAKI

SEQ ID NO: 144 - protein, 653 aa, Artificial Sequence
  Description of Artificial Sequence: Synthetic polypeptide
METDTLLLWVLLLWVPGSTGLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSAAATGTTTPAPRPPTPAPTIASQPLSLRPEACRPAAGGAVHTRGLDFACDIYIWAPLAGTCGVLLLSLVITLYCALYLLRRDQRLPPDAHKPPGGGSFRTPIQEEQADAHSTLAKI

SEQ ID NO: 145 - protein, 21 aa, Artificial Sequence
  Description of Artificial Sequence: Synthetic peptide
IYIWAPLAGTCGVLLLSLVIT

SEQ ID NO: 146 - protein, 27 aa, Artificial Sequence
  Description of Artificial Sequence: Synthetic peptide
IISFFLALTSTALLFLLFFLTLRFSVV

SEQ ID NO: 147 - protein, 21 aa, Artificial Sequence
  Description of Artificial Sequence: Synthetic peptide
ILVIFSGMFLVFTLAGALFLH

SEQ ID NO: 148 - protein, 27 aa, Artificial Sequence
  Description of Artificial Sequence: Synthetic peptide
FWVLVVVGGVLACYSLLVTVAFIIFWV

SEQ ID NO: 149 - protein, 28 aa, Artificial Sequence
  Description of Artificial Sequence: Synthetic peptide
PVLDAGPVLFWVILVLVVVVGSSAFLLC

SEQ ID NO: 150 - protein, 21 aa, Artificial Sequence
  Description of Artificial Sequence: Synthetic peptide
VAAILGLGLVLGLLGPLAILL

SEQ ID NO: 151 - protein, 42 aa, Artificial Sequence
  Description of Artificial Sequence: Synthetic polypeptide
KRGRKKLLYIFKQPFMRPVQTTQEEDGCSCRFPEEEEGGCEL

SEQ ID NO: 152 - protein, 48 aa, Artificial Sequence
  Description of Artificial Sequence: Synthetic polypeptide
QRRKYRSNKGESPVEPAEPCRYSCPREEEGSTIPIQEDYRKPEPACSP

SEQ ID NO: 153 - protein, 41 aa, Artificial Sequence
  Description of Artificial Sequence: Synthetic polypeptide
RSKRSRLLHSDYMNMTPRRPGPTRKHYQPYAPPRDFAAYRS

SEQ ID NO: 154 - protein, 188 aa, Artificial Sequence
  Description of Artificial Sequence: Synthetic polypeptide
HRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 155 - protein, 42 aa, Artificial Sequence
  Description of Artificial Sequence: Synthetic polypeptide
ALYLLRRDQRLPPDAHKPPGGGSFRTPIQEEQADAHSTLAKI

SEQ ID NO: 156 - protein, 120 aa, Artificial Sequence
  Description of Artificial Sequence: Synthetic polypeptide
EQKLISEEDLAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 157 - protein, 107 aa, Artificial Sequence
  Description of Artificial Sequence: Synthetic polypeptide
IEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 158 - protein, 109 aa, Artificial Sequence
  Description of Artificial Sequence: Synthetic polypeptide
EQKLISEEDLAAATGPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 159 - protein, 94 aa, Artificial Sequence
  Description of Artificial Sequence: Synthetic polypeptide
PADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 160 - protein, 134 aa, Artificial Sequence
  Description of Artificial Sequence: Synthetic polypeptide
EQKLISEEDLAAATGPTHLPYVSEMLEARTAGHMQTLADFRQLPARTLSTHWPPQRSLCSSDFIRILVIFSGMFLVFTLAGALFLHQRRKYRSNKGESPVEPAEPCRYSCPREEEGSTIPIQEDYRKPEPACSP

SEQ ID NO: 161 - protein, 119 aa, Artificial Sequence
  Description of Artificial Sequence: Synthetic polypeptide
PTHLPYVSEMLEARTAGHMQTLADFRQLPARTLSTHWPPQRSLCSSDFIRILVIFSGMFLVFTLAGALFLHQRRKYRSNKGESPVEPAEPCRYSCPREEEGSTIPIQEDYRKPEPACSP

SEQ ID NO: 162 - protein, 285 aa, Artificial Sequence
  Description of Artificial Sequence: Synthetic polypeptide
EQKLISEEDLAAATGAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 163 - protein, 270 aa, Artificial Sequence
  Description of Artificial Sequence: Synthetic polypeptide
APPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 164 - protein, 125 aa, Artificial Sequence
  Description of Artificial Sequence: Synthetic polypeptide
EQKLISEEDLAAATGDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 165 - protein, 110 aa, Artificial Sequence
  Description of Artificial Sequence: Synthetic polypeptide
DRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 166 - protein, 132 aa, Artificial Sequence
  Description of Artificial Sequence: Synthetic polypeptide
EQKLISEEDLAAATGTTTPAPRPPTPAPTIASQPLSLRPEACRPAAGGAVHTRGLDFACDIYIWAPLAGTCGVLLLSLVITLYCQRRKYRSNKGESPVEPAEPCRYSCPREEEGSTIPIQEDYRKPEPACSP

SEQ ID NO: 167 - protein, 117 aa, Artificial Sequence
  Description of Artificial Sequence: Synthetic polypeptide
TTTPAPRPPTPAPTIASQPLSLRPEACRPAAGGAVHTRGLDFACDIYIWAPLAGTCGVLLLSLVITLYCQRRKYRSNKGESPVEPAEPCRYSCPREEEGSTIPIQEDYRKPEPACSP

SEQ ID NO: 168 - protein, 272 aa, Artificial Sequence
  Description of Artificial Sequence: Synthetic polypeptide
EQKLISEEDLAAATGTTTPAPRPPTPAPTIASQPLSLRPEACRPAAGGAVHTRGLDFACDIYIWAPLAGTCGVLLLSLVITLYCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 169 - protein, 257 aa, Artificial Sequence
  Description of Artificial Sequence: Synthetic polypeptide
TTTPAPRPPTPAPTIASQPLSLRPEACRPAAGGAVHTRGLDFACDIYIWAPLAGTCGVLLLSLVITLYCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 170 - protein, 126 aa, Artificial Sequence
  Description of Artificial Sequence: Synthetic polypeptide
EQKLISEEDLAAATGTTTPAPRPPTPAPTIASQPLSLRPEACRPAAGGAVHTRGLDFACDIYIWAPLAGTCGVLLLSLVITLYCALYLLRRDQRLPPDAHKPPGGGSFRTPIQEEQADAHSTLAKI

SEQ ID NO: 171 - protein, 111 aa, Artificial Sequence
  Description of Artificial Sequence: Synthetic polypeptide
TTTPAPRPPTPAPTIASQPLSLRPEACRPAAGGAVHTRGLDFACDIYIWAPLAGTCGVLLLSLVITLYCALYLLRRDQRLPPDAHKPPGGGSFRTPIQEEQADAHSTLAKI

SEQ ID NO: 172 - protein, 126 aa, Artificial Sequence
  Description of Artificial Sequence: Synthetic polypeptide
EQKLISEEDLAAATGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCEL

SEQ ID NO: 173 - protein, 111 aa, Artificial Sequence
  Description of Artificial Sequence: Synthetic polypeptide
TTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCEL

SEQ ID NO: 174 - protein, 130 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSS

SEQ ID NO: 175 - protein, 108 aa, Artificial Sequence
  Description of Artificial Sequence: Synthetic polypeptide
LPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVL

SEQ ID NO: 176 - protein, 118 aa, Artificial Sequence
  Description of Artificial Sequence: Synthetic polypeptide
QVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSS

SEQ ID NO: 177 - protein, 108 aa, Artificial Sequence
  Description of Artificial Sequence: Synthetic polypeptide
DIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKR

SEQ ID NO: 178 - protein, 121 aa, Artificial Sequence
  Description of Artificial Sequence: Synthetic polypeptide
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSS

SEQ ID NO: 179 - protein, 107 aa, Artificial Sequence
  Description of Artificial Sequence: Synthetic polypeptide
QIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKR

SEQ ID NO: 180 - protein, 103 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 181 - protein, 103 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYELVSVVTVPSSSLGTQTYICNVNHKPSNTKVDKRVEPKSC

SEQ ID NO: 182 - protein, 106 aa, Artificial Sequence
  Description of Artificial Sequence: Synthetic polypeptide
GQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 183 - protein, 106 aa, Artificial Sequence
  Description of Artificial Sequence: Synthetic polypeptide
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 184 - protein, 106 aa, Artificial Sequence
  Description of Artificial Sequence: Synthetic polypeptide
TVAAPSVFIFPPSDEQLKSGTASVVCLLNNFYPREAKVQWKVDNALQSGNSQESVTEQDSKDSTYSLLSSLTLSKADYEKHKVYACEVTHQGLSSPVTKSFNRGEC

SEQ ID NO: 185 - protein, 260 aa, Artificial Sequence
  Description of Artificial Sequence: Synthetic polypeptide
LPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSS

SEQ ID NO: 186 - protein, 247 aa, Artificial Sequence
  Description of Artificial Sequence: Synthetic polypeptide
DIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSS

SEQ ID NO: 187 - protein, 247 aa, Artificial Sequence
  Description of Artificial Sequence: Synthetic polypeptide
QIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSS

SEQ ID NO: 188 - protein, 517 aa, Artificial Sequence
  Description of Artificial Sequence: Synthetic polypeptide
LPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGSRGGGGSGGGGSGGGGSLEMAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSGGGGSGGGGSQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRSRGGGGSGGGGSGGGGSLEQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSS

SEQ ID NO: 189 - protein, 20 aa, Artificial Sequence
  Description of Artificial Sequence: Synthetic peptide
METDTLLLWVLLLWVPGSTG

SEQ ID NO: 190 - protein, 32 aa, Artificial Sequence
  Description of Artificial Sequence: Synthetic polypeptide
RAKRSGSGAPVKQTLNFDLLKLAGDVESNPGP

SEQ ID NO: 191 - protein, 22 aa, Artificial Sequence
  Description of Artificial Sequence: Synthetic peptide
GSGATNFSLLKQAGDVEENPGP

SEQ ID NO: 192 - protein, 68 aa, Artificial Sequence
  Description of Artificial Sequence: Synthetic polypeptide
EVKTDSTDHVKPKETENTKQPSKSCHKPKAIVHTEKVNMMSLTVLGLRMLFAKTVAVNFLLTAKLFFL

SEQ ID NO: 193 - protein, 67 aa, Artificial Sequence
  Description of Artificial Sequence: Synthetic polypeptide
PIKTDVITMDPKDNCSKDANDTLLLQLTNTSAYYMYLLLLLKSVVYFAIITCCLLRRTAFCCNGEKS

SEQ ID NO: 194 - protein, 10 aa, Artificial Sequence
  Description of Artificial Sequence: Synthetic peptide
EQKLISEEDL

SEQ ID NO: 195 - protein, 22 aa, Artificial Sequence
  Description of Artificial Sequence: Synthetic peptide
DYKDHDGDYKDHDIDYKDDDDK

SEQ ID NO: 196 - protein, 22 aa, Artificial Sequence
  Description of Artificial Sequence: Synthetic peptide
GSRGGGGSGGGGSGGGGSLEMA

SEQ ID NO: 197 - protein, 21 aa, Artificial Sequence
  Description of Artificial Sequence: Synthetic peptide
SRGGGGSGGGGSGGGGSLEMA

SEQ ID NO: 198 - protein, 5 aa, Artificial Sequence
  Description of Artificial Sequence: Synthetic peptide
GGGGS

SEQ ID NO: 199 - protein, 10 aa, Artificial Sequence
  Description of Artificial Sequence: Synthetic peptide
GGGGSGGGGS

SEQ ID NO: 200 - protein, 15 aa, Artificial Sequence
  Description of Artificial Sequence: Synthetic peptide
GGGGSGGGGSGGGGS

SEQ ID NO: 201 - protein, 5 aa, Artificial Sequence
  Description of Artificial Sequence: Synthetic peptide
AAATG

SEQ ID NO: 202 - protein, 3 aa, Artificial Sequence
  Description of Artificial Sequence: Synthetic peptide
AAA

SEQ ID NO: 203 - protein, 11 aa, Artificial Sequence
  Description of Artificial Sequence: Synthetic peptide
TPLGDTTHTSG

SEQ ID NO: 204 - protein, 847 aa, Homo sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 205 - protein, 274 aa, Homo sapiens
DVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRR

SEQ ID NO: 206 - protein, 8 aa, Artificial Sequence
  Description of Artificial Sequence: Synthetic peptide
SSNIGNNY

SEQ ID NO: 207 - protein, 3 aa, Artificial Sequence
  Description of Artificial Sequence: Synthetic peptide
ENN

SEQ ID NO: 208 - protein, 12 aa, Artificial Sequence
  Description of Artificial Sequence: Synthetic peptide
GTWDSSLSAGAV

SEQ ID NO: 209 - protein, 8 aa, Artificial Sequence
  Description of Artificial Sequence: Synthetic peptide
GFTFSNYA

SEQ ID NO: 210 - protein, 8 aa, Artificial Sequence
  Description of Artificial Sequence: Synthetic peptide
ISGSGGST

SEQ ID NO: 211 - protein, 7 aa, Artificial Sequence
  Description of Artificial Sequence: Synthetic peptide
ARPYYDD

SEQ ID NO: 212 - protein, 112 aa, Artificial Sequence
  Description of Artificial Sequence: Synthetic polypeptide
QSVVTQPPSVSAAPGQKVTISCSGSSSNIGNNYVSWYQQLPGTAPKLLIYENNKRPSGIPDRFSGSKSGTSATLGITGLQTGDEADYYCGTWDSSLSAGAVFGGGTKLTVLG

SEQ ID NO: 213 - protein, 114 aa, Artificial Sequence
  Description of Artificial Sequence: Synthetic polypeptide
EVQLVESGGGLVQPGGSLRLSCAASGFTFSNYAMSWVRQAPGKGLEWVSAISGSGGSTYYADSVKGRFTISRDNSKNTLYLQMNSLRAEDTAVYYCARPYYDDWGQGTLVTVSS

SEQ ID NO: 214 - protein, 6 aa, Artificial Sequence
  Description of Artificial Sequence: Synthetic peptide
HDIRNY

SEQ ID NO: 215 - protein, 3 aa, Artificial Sequence
  Description of Artificial Sequence: Synthetic peptide
AAS

SEQ ID NO: 216 - protein, 9 aa, Artificial Sequence
  Description of Artificial Sequence: Synthetic peptide
QQYDGLPLT

SEQ ID NO: 217 - protein, 11 aa, Artificial Sequence
  Description of Artificial Sequence: Synthetic peptide
ARYGSAAWMDS

SEQ ID NO: 218 - protein, 108 aa, Artificial Sequence; identical to SEQ ID NO: 177
  Description of Artificial Sequence: Synthetic polypeptide

SEQ ID NO: 219 - protein, 118 aa, Artificial Sequence; identical to SEQ ID NO: 176
  Description of Artificial Sequence: Synthetic polypeptide

SEQ ID NO: 220 - protein, 5 aa, Artificial Sequence
  Description of Artificial Sequence: Synthetic peptide
GGGGS

SEQ ID NO: 221 - protein, 4 aa, Artificial Sequence
  Description of Artificial Sequence: Synthetic peptide
GGSG

SEQ ID NO: 222 - protein, 4 aa, Artificial Sequence
  Description of Artificial Sequence: Synthetic peptide
SGGG

SEQ ID NO: 223 - protein, 4 aa, Artificial Sequence
  Description of Artificial Sequence: Synthetic peptide
GSGS

SEQ ID NO: 224 - protein, 6 aa, Artificial Sequence
  Description of Artificial Sequence: Synthetic peptide
GSGSGS

SEQ ID NO: 225 - protein, 8 aa, Artificial Sequence
  Description of Artificial Sequence: Synthetic peptide
GSGSGSGS

SEQ ID NO: 226 - protein, 10 aa, Artificial Sequence
  Description of Artificial Sequence: Synthetic peptide
GSGSGSGSGS

SEQ ID NO: 227 - protein, 6 aa, Artificial Sequence
  Description of Artificial Sequence: Synthetic peptide
GGSGGS

SEQ ID NO: 228 - protein, 9 aa, Artificial Sequence
  Description of Artificial Sequence: Synthetic peptide
GGSGGSGGS

SEQ ID NO: 229 - protein, 12 aa, Artificial Sequence
  Description of Artificial Sequence: Synthetic peptide
GGSGGSGGSGGS

SEQ ID NO: 230 - protein, 4 aa, Artificial Sequence
  Description of Artificial Sequence: Synthetic peptide
GGSG

SEQ ID NO: 231 - protein, 8 aa, Artificial Sequence
  Description of Artificial Sequence: Synthetic peptide
GGSGGGSG

SEQ ID NO: 232 - protein, 12 aa, Artificial Sequence
  Description of Artificial Sequence: Synthetic peptide
GGSGGGSGGGSG

SEQ ID NO: 233 - protein, 21 aa, Artificial Sequence
  Description of Artificial Sequence: Synthetic peptide
SRGGGGSGGGGSGGGGSLEMA

SEQ ID NO: 234 - protein, 6 aa, Artificial Sequence
  Description of Artificial Sequence: Synthetic 6xHis tag
HHHHHH

SEQ ID NO: 235 - protein, 9 aa, Artificial Sequence
  Description of Artificial Sequence: Synthetic peptide
YPYDVPDYA

SEQ ID NO: 236 - protein, 10 aa, Artificial Sequence
  Description of Artificial Sequence: Synthetic peptide
YPYDVPDYAS

SEQ ID NO: 237 - protein, 8 aa, Artificial Sequence
  Description of Artificial Sequence: Synthetic peptide
DYKDDDDK

SEQ ID NO: 238 - protein, 10 aa, Artificial Sequence
  Description of Artificial Sequence: Synthetic peptide
EQKLISEEDL

SEQ ID NO: 239 - protein, 272 aa, Artificial Sequence
  Description of Artificial Sequence: Synthetic polypeptide
QSVVTQPPSVSAAPGQKVTISCSGSSSNIGNNYVSWYQQLPGTAPKLLIYENNKRPSGIPDRFSGSKSGTSATLGITGLQTGDEADYYCGTWDSSLSAGAVFGGGTKLTVLGSRGGGGSGGGGSGGGGSLEMAEVQLVESGGGLVQPGGSLRLSCAASGFTFSNYAMSWVRQAPGKGLEWVSAISGSGGSTYYADSVKGRFTISRDNSKNTLYLQMNSLRAEDTAVYYCARPYYDDWGQGTLVTVSSTSGQAGQHHHHHHGAYPYDVPDYAS

SEQ ID NO: 240 - protein, 272 aa, Artificial Sequence
  Description of Artificial Sequence: Synthetic polypeptide
DIQLTQSPSSLSTSVGDRVTITCQASHDIRNYLNWYQQKPGKAPNLLIYAASNLQTGVPSRFSGRGSGTDFTLTISSLQPEDIATYYCQQYDGLPLTFGQGTRLEIKRSRGGGGSGGGGSGGGGSLEMAQVQLVESGGGLVQPGGSLRLSCAASGFTFSNYAMSWVRQAPGKGLEWVSSISGSGGSTYYADSVKGRFTISRDTSKNTLYLQMNSLRAEDTAVYYCARYGSAAWMDSWGQGTLVTVSSTSGQAGQHHHHHHGAYPYDVPDYAS

SEQ ID NO: 241 - protein, 27 aa, Artificial Sequence
  Description of Artificial Sequence: Synthetic peptide
YPYDVPDYAYPYDVPDYAYPYDVPDYA

SEQ ID NO: 242 - protein, 30 aa, Artificial Sequence
  Description of Artificial Sequence: Synthetic polypeptide
YPYDVPDYASYPYDVPDYASYPYDVPDYAS

SEQ ID NO: 243 - protein, 24 aa, Artificial Sequence
  Description of Artificial Sequence: Synthetic peptide
DYKDDDDKDYKDDDDKDYKDDDDK

SEQ ID NO: 244 - protein, 30 aa, Artificial Sequence
  Description of Artificial Sequence: Synthetic polypeptide
EQKLISEEDLEQKLISEEDLEQKLISEEDL

What is claimed:

1. An anti-CD22 construct comprising an antibody moiety that specifically binds to CD22, wherein the antibody moiety comprises:
   (a) a light chain variable region ($V_L$) comprising a light chain complementarity determining region (LC-CDR) 1, an LC-CDR2, and an LC-CDR3 of the light chain variable region of SEQ ID NO:218 or 212; and
   (b) a heavy chain variable region ($V_H$) comprising a heavy chain complementarity determining region (HC-CDR) 1, an HC-CDR2, and an HC-CDR3 of the heavy chain variable region of SEQ ID NO:219 or 213.

2. The anti-CD22 construct of claim 1, wherein the antibody moiety comprises one or more of:
   the LC-CDR1 having a sequence of HDIRNY (SEQ ID NO:214),
   the LC-CDR2 having a sequence of AAS (SEQ ID NO:215),
   the LC-CDR3 having a sequence of QQYDGLPLT (SEQ ID NO:216),
   the HC-CDR1 having a sequence of GFTFSNYA (SEQ ID NO:209),
   the HC-CDR2 having a sequence of ISGSGGST (SEQ ID NO:210), and
   the HC-CDR3 having a sequence of ARYGSAAWMDS (SEQ ID NO:217).

3. The anti-CD22 construct of claim 2, wherein the light chain variable region has a sequence having at least 90% identity to the sequence of DIQLTQSPSSLSTSVGDRVTITCQASHDIR-NYLNWYQQKPGKAPNLLIYAASNLQTGVPS RF SGRGSGTDFTLTIS SLQPEDIATYYCQQYDG-LPLTFGQGTRLEIKR (SEQ ID NO:218), and/or
   wherein the heavy chain variable region has a sequence having at least 90% identity to the sequence of QVQLVESGGGLVQPGGSLRLS-CAASGFTFSNYAMSWVRQAPGKGLEWVSSIS-GSGGST YYADSVKGRFTISRDTSKNT-LYLQMNSLRAEDTAVYYCARYGSAAWMDS WGQGTLVT VSS (SEQ ID NO:219).

4. The anti-CD22 construct of claim 1, wherein the antibody moiety comprises one or more of:
   the LC-CDR1 having a sequence of SSNIGNNY (SEQ ID NO:206),
   the LC-CDR2 having a sequence of ENN (SEQ ID NO:207),
   the LC-CDR3 having a sequence of GTWDSSLSAGAV (SEQ ID NO:208),
   the HC-CDR1 having a sequence of GFTFSNYA (SEQ ID NO:209),
   the HC-CDR2 having a sequence of ISGSGGST (SEQ ID NO:210), and
   the HC-CDR3 having a sequence of ARPYYDD (SEQ ID NO:211).

5. The anti-CD22 construct of claim 1 or 4, wherein the light chain variable region has a sequence having at least 90% identity to the sequence of QSVVTQPPSVSAAPGQKVTISCSGSSS-NIGNNYVSWYQQLPGTAPKLLIYENNKRPSGIP DRFSGSKSGTSATLGITGLQTGDEADYYCGTWDSSL-SAGAVFGGGTKLTVLG (SEQ ID NO:212), and/or
   wherein the heavy chain variable region has a sequence having at least 90% identity to the sequence of EVQLVESGGGLVQPGGSLRLS-CAASGFTFSNYAMSWVRQAPGKGLEWVSAIS-GSGGST YYADSVKGRFTISRDNSKNT-LYLQMNSLRAEDTAVYYCARPYYDDWGQ GTLVTVS S (SEQ ID NO:213).

6. The anti-CD22 construct of claim 1, wherein the construct is a full-length antibody, a Fab, a Fab', a F(ab')2, an Fv, a single chain Fv (scFv) antibody, a tandem scFv, a diabody (Db), a single chain diabody (scDb), a dual-affinity retargeting (DART) antibody, a dual variable domain (DVD) antibody, a knob-into-hole (KiH) antibody, a dock and lock (DNL) antibody, a chemically cross-linked antibody, a heteromultimeric antibody, or a heteroconjugate antibody.

7. The anti-CD22 construct of claim 1, wherein the construct further comprises a second antibody moiety that specifically binds to a second antigen, and wherein the second antigen is an antigen on the surface of a T cell, a natural killer cell, a neutrophil, a monocyte, a macrophage, or a dendritic cell.

8. A chimeric anti-CD22 construct comprising the anti-CD22 construct of claim 1, wherein the anti-CD22 construct is either (a) a chimeric antigen receptor (CAR) or (b) a chimeric antibody-T cell receptor (caTCR) comprising an extracellular domain that binds to CD22 and a T cell receptor (TCR) module (TCRM) comprising TCR transmembrane domains.

9. The anti-CD22 construct of claim 8, wherein the anti-CD22 construct is a CAR, and wherein:
   (A) the CAR comprises an anti-CD22 antibody moiety, a transmembrane domain, and an immune cell signaling domain, wherein the anti-CD22 antibody moiety is a scFv comprising the LC-CDR1, the LC-CDR2, and the LC-CDR3 having the sequences of SEQ ID NOS:214-216, respectively, the HC-CDR1, the HC-CDR2, and the HC-CDR3 having the sequences of SEQ ID NOS: 209, 210, and 217, respectively; or
   (b) the CAR comprises an anti-CD22 antibody moiety, a transmembrane domain, and an immune cell signaling domain, wherein the anti-CD22 antibody moiety is a scFv comprising the LC-CDR1, the LC-CDR2, and the LC-CDR3 having the sequences of SEQ ID NOS:206-208, respectively, the HC-CDR1, the HC-CDR2, and the HC-CDR3 having the sequences of SEQ ID NOS: 209-211, respectively.

10. The anti-CD22 construct of claim 8, wherein the anti-CD22 construct is a caTCR, and wherein:
    (a) the caTCR comprises LC-CDR1, LC-CDR2, and LC-CDR3 having the sequences of SEQ ID NOS:214-216, respectively, and HC-CDR1, HC-CDR2, and HC-CDR3 having the sequences of SEQ ID NOS:209, 210, and 217, respectively; or
    (b) the caTCR comprises LC-CDR1, LC-CDR2, and LC-CDR3 having the sequences of SEQ ID NOS:206-208, respectively, and HC-CDR1, HC-CDR2, and HC-CDR3 having the sequences of SEQ ID NOS:209-211 respectively.

11. The anti-CD22 construct of claim 8, wherein the anti-CD22 construct is a caTCR, and wherein:
    (1) the extracellular domain comprises:
       (a) a first polypeptide comprising a first antigen-binding region comprising a heavy chain variable region ($V_H$) and a $C_H1$ constant domain; and
       (b) a second polypeptide chain comprising a second antigen-binding region comprising a light chain variable region ($V_L$) and a $C_L$ constant domain, wherein the $V_H$ and the $C_H1$ constant domain of the first antigen-binding region and the $V_L$ and the $C_L$ constant domain of the second antigen-binding region form a Fab-like antigen-binding module that specifically binds to CD22; or (2) the extracellular domain further comprises at least one additional antibody moiety that specifically binds to at least one non-CD22 antigen.

12. The anti-CD22 construct of claim 8, wherein the anti-CD22 construct is a caTCR, and wherein the caTCR is expressed in combination with a chimeric signaling receptor (CSR).

13. An anti-CD22 construct which is a chimeric signaling receptor (CSR) further comprising:
(a) the anti-CD22 construct of claim 1;
(b) a transmembrane module; and
(c) a co-stimulatory immune cell signaling module that is capable of providing a costimulatory signal to the immune cell,
wherein the CSR lacks a functional primary immune cell signaling domain.

14. The anti-CD22 construct of claim 13, wherein:
(a) the anti-CD22 antibody moiety comprises the LC-CDR1, the LC-CDR2, and the LC-CDR3 having the sequences of SEQ ID NOS:214-216, respectively, the HC-CDR1, the HC-CDR2, and the HC-CDR3 having the sequences of SEQ ID NOS:209, 210, and 217, respectively; or
(b) the anti-CD22 antibody moiety comprises the LC-CDR1, the LC-CDR2, and the LC-CDR3 having the sequences of SEQ ID NOS:206-208, respectively, the HC-CDR1, the HC-CDR2, and the HC-CDR3 having the sequences of SEQ ID NOS:209-211, respectively.

15. The anti-CD22 construct of any one of claim 13, wherein the CSR is expressed in combination with a caTCR or CAR.

16. A nucleic acid molecule encoding one or more polypeptides contained in the anti-CD22 construct of claim 1.

17. A pharmaceutical composition comprising a therapeutically effective amount of the anti-CD22 construct of claim 1 and one or more pharmaceutically acceptable carriers or excipients.

18. A method of treating a B-cell malignancy or a disease or disorder characterized by CD22 overexpression in a subject in need thereof, comprising administering to the subject a therapeutically effective amount of the anti-CD22 construct of claim 1.

19. A method of treatment of a B-cell malignancy or a disease or disorder characterized by CD22 overexpression in a subject in need thereof, comprising introducing the nucleic acid molecule of claim 16 into one or more primary cells isolated from a subject and administering cells comprising the nucleic acid molecule to the subject.

20. A method of diagnosing a subject having a B-cell malignancy, comprising:
(a) contacting a sample derived from the subject with the anti-CD22 construct of claim 1; and
(b) determining the number of cells bound with the anti-CD22 construct in the sample,
wherein a value for the number of cells bound with the anti-CD22 construct above a threshold level indicates that the subject has the B-cell malignancy.

* * * * *